United States Patent 12,508,308 (INFLUENZA mRNA VACCINES) - sequence listing, part 41

SEQ ID NO: 157909 - RNA, 1701 nt, Artificial Sequence
  derived and/or modified sequence opt4 from hemagglutinin__InfluenzaA__ADK98876
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacggccaguucgacaagcuguacaucuggggcgugcaccaccccggcaccgacaaggaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 157910 - RNA, 1701 nt, Artificial Sequence; identical to SEQ ID NO: 157884
  derived and/or modified sequence opt4 from hemagglutinin__InfluenzaA__ADK98887

SEQ ID NO: 157911 - RNA, 1701 nt, Artificial Sequence; identical to SEQ ID NO: 154954
  derived and/or modified sequence opt4 from hemagglutinin__InfluenzaA__ADK98898

SEQ ID NO: 157912 - RNA, 1701 nt, Artificial Sequence
  derived and/or modified sequence opt4 from hemagglutinin__InfluenzaA__ADK98909
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaucagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 157913 - RNA, 1701 nt, Artificial Sequence
  derived and/or modified sequence opt4 from hemagglutinin__InfluenzaA__ADK98920
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaggcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 157914 - RNA, 1701 nt, Artificial Sequence; identical to SEQ ID NO: 154954
  derived and/or modified sequence opt4 from hemagglutinin__InfluenzaA__ADK98931

SEQ ID NO: 157915 - RNA, 1701 nt, Artificial Sequence
  derived and/or modified sequence opt4 from hemagglutinin__InfluenzaA__ADK98942
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugaucagcaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 157916 - RNA, 1701 nt, Artificial Sequence
  derived and/or modified sequence opt4 from hemagglutinin__InfluenzaA__ADK98953
augaagaccaucaucgcccugagcuacaugcugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugaucgccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 157917 - RNA, 1701 nt, Artificial Sequence; identical to SEQ ID NO: 154954
  derived and/or modified sequence opt4 from hemagglutinin__InfluenzaA__ADK98964

SEQ ID NO: 157918 - RNA, 1701 nt, Artificial Sequence; identical to SEQ ID NO: 157871
  derived and/or modified sequence opt4 from hemagglutinin__InfluenzaA__ADK98975

SEQ ID NO: 157919 - RNA, 1701 nt, Artificial Sequence; identical to SEQ ID NO: 157916
  derived and/or modified sequence opt4 from hemagglutinin__InfluenzaA__ADK98986

SEQ ID NO: 157920 - RNA, 1701 nt, Artificial Sequence; identical to SEQ ID NO: 156133
  derived and/or modified sequence opt4 from hemagglutinin__InfluenzaA__ADK98997

SEQ ID NO: 157921 - RNA, 1701 nt, Artificial Sequence; identical to SEQ ID NO: 157916
  derived and/or modified sequence opt4 from hemagglutinin__InfluenzaA__ADK99008

SEQ ID NO: 157922 - RNA, 1701 nt, Artificial Sequence
  derived and/or modified sequence opt4 from hemagglutinin__InfluenzaA__ADK99030
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacgagagauucgacaagcuguacaucuggggcgugcaccaccccggcaccgacaaggaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 157923 - RNA, 1701 nt, Artificial Sequence
  derived and/or modified sequence opt4 from hemagglutinin__InfluenzaA__ADK99041
augaagaccaucaucgcccugagcuacauccugugccugguguucgcccagaagcugcccggcaacgacaacagcaccgccacccugugccugggccaccacgccgugcccaacggcaccaucgugaagaccaucgccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 157924 - RNA, 1701 nt, Artificial Sequence; identical to SEQ ID NO: 157871
  derived and/or modified sequence opt4 from hemagglutinin__InfluenzaA__ADK99063

SEQ ID NO: 157925 - RNA, 1701 nt, Artificial Sequence; identical to SEQ ID NO: 154954
  derived and/or modified sequence opt4 from hemagglutinin__InfluenzaA__ADK99085

SEQ ID NO: 157926 - RNA, 1701 nt, Artificial Sequence; identical to SEQ ID NO: 154954
  derived and/or modified sequence opt4 from hemagglutinin__InfluenzaA__ADK99096

SEQ ID NO: 157927 - RNA, 1701 nt, Artificial Sequence; identical to SEQ ID NO: 154954
  derived and/or modified sequence opt4 from hemagglutinin__InfluenzaA__ADK99107

SEQ ID NO: 157928 - RNA, 1701 nt, Artificial Sequence
  derived and/or modified sequence opt4 from hemagglutinin__InfluenzaA__ADK99118
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacaucccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcaacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 157929 - RNA, 1701 nt, Artificial Sequence
  derived and/or modified sequence opt4 from hemagglutinin__InfluenzaA__ADK99129
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacaugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcaacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 157930 - RNA, 1701 nt, Artificial Sequence; identical to SEQ ID NO: 157871
  derived and/or modified sequence opt4 from hemagglutinin__InfluenzaA__ADK99140

SEQ ID NO: 157931 - RNA, 1701 nt, Artificial Sequence
  derived and/or modified sequence opt4 from hemagglutinin__InfluenzaA__ADK99151
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggccugcagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgccauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcaagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 157932 - RNA, 1701 nt, Artificial Sequence; identical to SEQ ID NO: 157871
  derived and/or modified sequence opt4 from hemagglutinin__InfluenzaA__ADK99162

SEQ ID NO: 157933 - RNA, 1701 nt, Artificial Sequence
  derived and/or modified sequence opt4 from hemagglutinin__InfluenzaA__ADK99173
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcugauccagagcagcagcaccggcgagaucugcgacagcccccaccagauccuggacggcgagaacugcacccugaucgacgcccugcugggcgacccccagugcgacggccugcagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 157934 - RNA, 1701 nt, Artificial Sequence
  derived and/or modified sequence opt4 from hemagglutinin__InfluenzaA__ADK99184
augaagaccaucaucgcccugagcuacauccugugccuggugagcgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 157935 - RNA, 1701 nt, Artificial Sequence; identical to SEQ ID NO: 154954
  derived and/or modified sequence opt4 from hemagglutinin__InfluenzaA__ADK99195

SEQ ID NO: 157936 - RNA, 1701 nt, Artificial Sequence
  derived and/or modified sequence opt4 from hemagglutinin__InfluenzaA__ADK99206
augaagaccaucaucgcccugagcuacauccugugccugguguucgcccagaagcugcccggcaacgacaacagcaccgccacccugugccugggccaccacgccgugcccaacggcaccguggugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcuggugagccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 157937 - RNA, 1701 nt, Artificial Sequence; identical to SEQ ID NO: 157871
  derived and/or modified sequence opt4 from hemagglutinin__InfluenzaA__ADK99217

SEQ ID NO: 157938 - RNA, 1701 nt, Artificial Sequence; identical to SEQ ID NO: 157871
  derived and/or modified sequence opt4 from hemagglutinin__InfluenzaA__ADK99228

SEQ ID NO: 157939 - RNA, 1701 nt, Artificial Sequence
  derived and/or modified sequence opt4 from hemagglutinin__InfluenzaA__ADK99239
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 157940 - RNA, 1701 nt, Artificial Sequence
  derived and/or modified sequence opt4 from hemagglutinin__InfluenzaA__ADK99250
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggacaucgagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 157941 - RNA, 1701 nt, Artificial Sequence; identical to SEQ ID NO: 157871
  derived and/or modified sequence opt4 from hemagglutinin__InfluenzaA__ADK99261

SEQ ID NO: 157942 - RNA, 1701 nt, Artificial Sequence
  derived and/or modified sequence opt4 from hemagglutinin__InfluenzaA__ADK99283
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagagauacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 157943 - RNA, 1701 nt, Artificial Sequence
  derived and/or modified sequence opt4 from hemagglutinin__InfluenzaA__ADK99294
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccaggacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 157944 - RNA, 1701 nt, Artificial Sequence; identical to SEQ ID NO: 154954
  derived and/or modified sequence opt4 from hemagglutinin__InfluenzaA__ADK99305

SEQ ID NO: 157945 - RNA, 1701 nt, Artificial Sequence; identical to SEQ ID NO: 154954
  derived and/or modified sequence opt4 from hemagglutinin__InfluenzaA__ADL27989

SEQ ID NO: 157946 - RNA, 1701 nt, Artificial Sequence
  derived and/or modified sequence opt4 from hemagglutinin__InfluenzaA__ADL28000
augaagaccaucaucgcccugagcuacauccugugccugguguucgcccagaagcugcccggcaacgacaacagcaccgccacccugugccugggccaccacgccgugcccaacggcaccauggugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcgagagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 157947 - RNA, 1701 nt, Artificial Sequence
  derived and/or modified sequence opt4 from hemagglutinin__InfluenzaA__ADL28011
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccagaagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 157948 - RNA, 1701 nt, Artificial Sequence; identical to SEQ ID NO: 157871
  derived and/or modified sequence opt4 from hemagglutinin__InfluenzaA__ADL28022

SEQ ID NO: 157949 - RNA, 1701 nt, Artificial Sequence; identical to SEQ ID NO: 154954
  derived and/or modified sequence opt4 from hemagglutinin__InfluenzaA__ADL28033

SEQ ID NO: 157950 - RNA, 1701 nt, Artificial Sequence; identical to SEQ ID NO: 156133
  derived and/or modified sequence opt4 from hemagglutinin__InfluenzaA__ADL28044

SEQ ID NO: 157951 - RNA, 1701 nt, Artificial Sequence
  derived and/or modified sequence opt4 from hemagglutinin__InfluenzaA__ADL28055
augaagaccaucguggcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 157952 - RNA, 1701 nt, Artificial Sequence; identical to SEQ ID NO: 154954
  derived and/or modified sequence opt4 from hemagglutinin__InfluenzaA__ADL28066

SEQ ID NO: 157953 - RNA, 1701 nt, Artificial Sequence; identical to SEQ ID NO: 157871
  derived and/or modified sequence opt4 from hemagglutinin__InfluenzaA__ADL28077

SEQ ID NO: 157954 - RNA, 1701 nt, Artificial Sequence
  derived and/or modified sequence opt4 from hemagglutinin__InfluenzaA__ADL28088
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacagccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 157955 - RNA, 1701 nt, Artificial Sequence; identical to SEQ ID NO: 154954
  derived and/or modified sequence opt4 from hemagglutinin__InfluenzaA__ADL28099

SEQ ID NO: 157956 - RNA, 1701 nt, Artificial Sequence
  derived and/or modified sequence opt4 from hemagglutinin__InfluenzaA__ADL28110
augaagaccaucaucgcccugagcuacauccugugccugguguucgcccagaagcugcccggcaacgacaacagcaccgccacccugugcaucggccaccacgccgugcccaacggcaccaucgugaagaccaucaccaacgaccagaucgaggugaccaacgccaccgagcuggugcagaacagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgccauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucgacaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 157957 - RNA, 1701 nt, Artificial Sequence
  derived and/or modified sequence opt4 from hemagglutinin__InfluenzaA__ADL28126
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugaaccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 157958 - RNA, 1701 nt, Artificial Sequence
  derived and/or modified sequence opt4 from hemagglutinin__InfluenzaA__ADL28137
augaagaccaucaucgcccugagcuacauccugugccuggugagcgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacggcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 157959 - RNA, 1701 nt, Artificial Sequence; identical to SEQ ID NO: 154954
  derived and/or modified sequence opt4 from hemagglutinin__InfluenzaA__ADL28148

SEQ ID NO: 157960 - RNA, 1701 nt, Artificial Sequence; identical to SEQ ID NO: 157871
  derived and/or modified sequence opt4 from hemagglutinin__InfluenzaA__ADL28170

SEQ ID NO: 157961 - RNA, 1701 nt, Artificial Sequence; identical to SEQ ID NO: 154954
  derived and/or modified sequence opt4 from hemagglutinin__InfluenzaA__ADL28181

SEQ ID NO: 157962 - RNA, 1701 nt, Artificial Sequence; identical to SEQ ID NO: 157866
  derived and/or modified sequence opt4 from hemagglutinin__InfluenzaA__ADL28192

SEQ ID NO: 157963 - RNA, 1701 nt, Artificial Sequence; identical to SEQ ID NO: 157872
  derived and/or modified sequence opt4 from hemagglutinin__InfluenzaA__ADL28203

SEQ ID NO: 157964 - RNA, 1701 nt, Artificial Sequence; identical to SEQ ID NO: 155931
  derived and/or modified sequence opt4 from hemagglutinin__InfluenzaA__ADL28214

SEQ ID NO: 157965 - RNA, 1701 nt, Artificial Sequence
  derived and/or modified sequence opt4 from hemagglutinin__InfluenzaA__ADL28225
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacagccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaccgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 157966 - RNA, 1701 nt, Artificial Sequence; identical to SEQ ID NO: 157871
  derived and/or modified sequence opt4 from hemagglutinin__InfluenzaA__ADL28236

SEQ ID NO: 157967 - RNA, 1701 nt, Artificial Sequence; identical to SEQ ID NO: 154954
  derived and/or modified sequence opt4 from hemagglutinin__InfluenzaA__ADL28247

SEQ ID NO: 157968 - RNA, 1701 nt, Artificial Sequence; identical to SEQ ID NO: 157884
  derived and/or modified sequence opt4 from hemagglutinin__InfluenzaA__ADL28258

SEQ ID NO: 157969 - RNA, 1701 nt, Artificial Sequence; identical to SEQ ID NO: 154954
  derived and/or modified sequence opt4 from hemagglutinin__InfluenzaA__ADL28370

SEQ ID NO: 157970 - RNA, 1701 nt, Artificial Sequence; identical to SEQ ID NO: 155189
  derived and/or modified sequence opt4 from hemagglutinin__InfluenzaA__ADL29672

SEQ ID NO: 157971 - RNA, 1701 nt, Artificial Sequence; identical to SEQ ID NO: 155431
  derived and/or modified sequence opt4 from hemagglutinin__InfluenzaA__ADL29682

SEQ ID NO: 157972 - RNA, 1701 nt, Artificial Sequence; identical to SEQ ID NO: 155189
  derived and/or modified sequence opt4 from hemagglutinin__InfluenzaA__ADL29692

SEQ ID NO: 157973 - RNA, 1701 nt, Artificial Sequence
  derived and/or modified sequence opt4 from hemagglutinin__InfluenzaA__ADL29702
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagaucgacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157974 - RNA, 1701 nt, Artificial Sequence; identical to SEQ ID NO: 155189
  derived and/or modified sequence opt4 from hemagglutinin__InfluenzaA__ADL29730

SEQ ID NO: 157975 - RNA, 1701 nt, Artificial Sequence; identical to SEQ ID NO: 155189
  derived and/or modified sequence opt4 from hemagglutinin__InfluenzaA__ADL29740

SEQ ID NO: 157976 - RNA, 1701 nt, Artificial Sequence; identical to SEQ ID NO: 155189
  derived and/or modified sequence opt4 from hemagglutinin__InfluenzaA__ADL29750

SEQ ID NO: 157977 - RNA, 1701 nt, Artificial Sequence
  derived and/or modified sequence opt4 from hemagglutinin__InfluenzaA__ADL29760
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaguacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157978 - RNA, 1701 nt, Artificial Sequence; identical to SEQ ID NO: 155189
  derived and/or modified sequence opt4 from hemagglutinin__InfluenzaA__ADL29770

SEQ ID NO: 157979 - RNA, 1701 nt, Artificial Sequence; identical to SEQ ID NO: 156689
  derived and/or modified sequence opt4 from hemagglutinin__InfluenzaA__ADL29780

SEQ ID NO: 157980 - RNA, 1701 nt, Artificial Sequence
  derived and/or modified sequence opt4 from hemagglutinin__InfluenzaA__ADL29879
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacagcuacguguucgugggcaccagcaaguacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157981 - RNA, 1701 nt, Artificial Sequence
  derived and/or modified sequence opt4 from hemagglutinin__InfluenzaA__ADL32017
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugccagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagaucgacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157982 - RNA, 1701 nt, Artificial Sequence
  derived and/or modified sequence opt4 from hemagglutinin__InfluenzaA__ADL32037
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcguggaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157983 - RNA, 1701 nt, Artificial Sequence; identical to SEQ ID NO: 155189
  derived and/or modified sequence opt4 from hemagglutinin__InfluenzaA__ADL32047

SEQ ID NO: 157984 - RNA, 1701 nt, Artificial Sequence
  derived and/or modified sequence opt4 from hemagglutinin__InfluenzaA__ADL32057
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagggccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagggcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157985 - RNA, 1701 nt, Artificial Sequence; identical to SEQ ID NO: 155189
  derived and/or modified sequence opt4 from hemagglutinin__InfluenzaA__ADL32090

SEQ ID NO: 157986 - RNA, 1701 nt, Artificial Sequence; identical to SEQ ID NO: 155189
  derived and/or modified sequence opt4 from hemagglutinin__InfluenzaA__ADL32114

SEQ ID NO: 157987 - RNA, 1701 nt, Artificial Sequence; identical to SEQ ID NO: 155189
  derived and/or modified sequence opt4 from hemagglutinin__InfluenzaA__ADL32344

SEQ ID NO: 157988 - RNA, 1701 nt, Artificial Sequence; identical to SEQ ID NO: 155636
  derived and/or modified sequence opt4 from hemagglutinin__InfluenzaA__ADL32354

SEQ ID NO: 157989 - RNA, 1701 nt, Artificial Sequence
  derived and/or modified sequence opt4 from hemagglutinin__InfluenzaA__ADL32364
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccaucagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagaucgacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157990 - RNA, 1701 nt, Artificial Sequence; identical to SEQ ID NO: 155189
  derived and/or modified sequence opt4 from hemagglutinin__InfluenzaA__ADL32374

SEQ ID NO: 157991 - RNA, 1701 nt, Artificial Sequence
  derived and/or modified sequence opt4 from hemagglutinin__InfluenzaA__ADL32384
augaaggccauccugguggugcugcuguacaccuucgccaccgccaccgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157992 - RNA, 1701 nt, Artificial Sequence
  derived and/or modified sequence opt4 from hemagglutinin__InfluenzaA__ADL32394
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagcuucagcaccaccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagaucgacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157993 - RNA, 1701 nt, Artificial Sequence; identical to SEQ ID NO: 155189
  derived and/or modified sequence opt4 from hemagglutinin__InfluenzaA__ADL32404

SEQ ID NO: 157994 - RNA, 1701 nt, Artificial Sequence
  derived and/or modified sequence opt4 from hemagglutinin__InfluenzaA__ADL32414
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagcccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagcacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157995 - RNA, 1701 nt, Artificial Sequence
  derived and/or modified sequence opt4 from hemagglutinin__InfluenzaA__ADL32424
augaaggccauccugguggugcugcuguacaccuucgccaucgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuaccacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagcacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucaacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157996 - RNA, 1701 nt, Artificial Sequence
  derived and/or modified sequence opt4 from hemagglutinin__InfluenzaA__ADL32434
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccauccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggauccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagcacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157997 - RNA, 1701 nt, Artificial Sequence; identical to SEQ ID NO: 156609
  derived and/or modified sequence opt4 from hemagglutinin__InfluenzaA__ADL32444

SEQ ID NO: 157998 - RNA, 1701 nt, Artificial Sequence
  derived and/or modified sequence opt4 from hemagglutinin__InfluenzaA__ADL32454
auggaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccacaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagcugggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157999 - RNA, 1701 nt, Artificial Sequence; identical to SEQ ID NO: 157356
  derived and/or modified sequence opt4 from hemagglutinin__InfluenzaA__ADL32464

SEQ ID NO: 158000 - RNA, 1701 nt, Artificial Sequence; identical to SEQ ID NO: 157356
  derived and/or modified sequence opt4 from hemagglutinin__InfluenzaA__ADL32484

SEQ ID NO: 158001 - RNA, 1701 nt, Artificial Sequence
  derived and/or modified sequence opt4 from hemagglutinin__InfluenzaA__ADL32504
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaugugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagcacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158002 - RNA, 1701 nt, Artificial Sequence; identical to SEQ ID NO: 156609
  derived and/or modified sequence opt4 from hemagglutinin__InfluenzaA__ADL32514

SEQ ID NO: 158003 - RNA, 1701 nt, Artificial Sequence; identical to SEQ ID NO: 157356
  derived and/or modified sequence opt4 from hemagglutinin__InfluenzaA__ADL32524

SEQ ID NO: 158004 - RNA, 1701 nt, Artificial Sequence
  derived and/or modified sequence opt4 from hemagglutinin__InfluenzaA__ADL32544
augaaggccauccugguggugcugcuguacaccuucgccaccagcaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagaaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagcacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158005 - RNA, 1701 nt, Artificial Sequence; identical to SEQ ID NO: 157790
  derived and/or modified sequence opt4 from hemagglutinin__InfluenzaA__ADL32554

SEQ ID NO: 158006 - RNA, 1701 nt, Artificial Sequence; identical to SEQ ID NO: 156802
  derived and/or modified sequence opt4 from hemagglutinin__InfluenzaA__ADL32670

SEQ ID NO: 158007 - RNA, 1701 nt, Artificial Sequence
  derived and/or modified sequence opt4 from hemagglutinin__InfluenzaA__ADL32690
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugauguggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158008 - RNA, 1701 nt, Artificial Sequence; identical to SEQ ID NO: 155369
  derived and/or modified sequence opt4 from hemagglutinin__InfluenzaA__ADL32710

SEQ ID NO: 158009 - RNA, 1701 nt, Artificial Sequence; identical to SEQ ID NO: 155189
  derived and/or modified sequence opt4 from hemagglutinin__InfluenzaA__ADL32720

SEQ ID NO: 158010 - RNA, 1701 nt, Artificial Sequence; identical to SEQ ID NO: 156961
  derived and/or modified sequence opt4 from hemagglutinin__InfluenzaA__ADL32730

SEQ ID NO: 158011 - RNA, 1701 nt, Artificial Sequence; identical to SEQ ID NO: 156961
  derived and/or modified sequence opt4 from hemagglutinin__InfluenzaA__ADL32740

SEQ ID NO: 158012 - RNA, 1701 nt, Artificial Sequence; identical to SEQ ID NO: 156133
  derived and/or modified sequence opt4 from hemagglutinin__InfluenzaA__ADL39137

SEQ ID NO: 158013 - RNA, 1698 nt, Artificial Sequence
  derived and/or modified sequence opt4 from hemagglutinin__InfluenzaA__ADL39148
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucguggaccagaagacccuguacagaaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagagacuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 158014 - RNA, 1701 nt, Artificial Sequence
  derived and/or modified sequence opt4 from hemagglutinin__InfluenzaA__ADL39159
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagaucaucgacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucagaagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcuucgcccugcugggcuucaucaugugggccugccagaagggcaacaucagaugcaacaucugcaucuga

SEQ ID NO: 158015 - RNA, 1701 nt, Artificial Sequence
  derived and/or modified sequence opt4 from hemagglutinin__InfluenzaA__ADL39170
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccgugcccaacaacgagcaguucgacaagcuguacaucuggggcgugcaccaccccggcaccgacaaggaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacgugcugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 158016 - RNA, 1701 nt, Artificial Sequence; identical to SEQ ID NO: 156133
  derived and/or modified sequence opt4 from hemagglutinin__InfluenzaA__ADL39203

SEQ ID NO: 158017 - RNA, 1701 nt, Artificial Sequence; identical to SEQ ID NO: 154954
  derived and/or modified sequence opt4 from hemagglutinin__InfluenzaA__ADL39214

SEQ ID NO: 158018 - RNA, 1698 nt, Artificial Sequence
  derived and/or modified sequence opt4 from hemagglutinin__InfluenzaA__ADL39225
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgccagcgccagcugcagccacaacggcgagaacagcuucuacagaaaccugcuguggcugaccggcaagaacggccuguaccccaaccugagcaagagcuacgccaacaacaaggagaaggaggugcuggugcuguggggcgugcaccacccccccaacaucgccgaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 158019 - RNA, 1698 nt, Artificial Sequence
  derived and/or modified sequence opt4 from hemagglutinin__InfluenzaA__ADL39236
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacaccaacaacaaggagaaggaggugcuggugcuguggggcgugcaccacccccccaacaucguggaccagaagacccuguacagaaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccaugggcaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 158020 - RNA, 1701 nt, Artificial Sequence
  derived and/or modified sequence opt4 from hemagglutinin__InfluenzaA__ADL39280
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugagauucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 158021 - RNA, 1698 nt, Artificial Sequence
  derived and/or modified sequence opt4 from hemagglutinin__InfluenzaA__ADL39291
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccgagaagaacggccuguaccccaaccugagcaagagcuacgccaacaacaaggagaaggaggugcuggugcuguggggcgugcaccacccccccaacaugggcgaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 158022 - RNA, 1701 nt, Artificial Sequence; identical to SEQ ID NO: 154954
  derived and/or modified sequence opt4 from hemagglutinin__InfluenzaA__ADL39302

SEQ ID NO: 158023 - RNA, 1701 nt, Artificial Sequence; identical to SEQ ID NO: 158020
  derived and/or modified sequence opt4 from hemagglutinin__InfluenzaA__ADL39313

SEQ ID NO: 158024 - RNA, 1701 nt, Artificial Sequence
  derived and/or modified sequence opt4 from hemagglutinin__InfluenzaA__ADL39335
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugagauucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccauccaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 158025 - RNA, 1701 nt, Artificial Sequence; identical to SEQ ID NO: 154954
  derived and/or modified sequence opt4 from hemagglutinin__InfluenzaA__ADL39368

SEQ ID NO: 158026 - RNA, 1698 nt, Artificial Sequence
  derived and/or modified sequence opt4 from hemagglutinin__InfluenzaA__ADL39390
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccagccugagcaagagcuacgccaacaacaaggagaaggaggugcuggugcuguggggcgugcaccacccccccaacaucguggaccagaagacccuguacagaaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccaugggcaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 158027 - RNA, 1701 nt, Artificial Sequence
  derived and/or modified sequence opt4 from hemagglutinin__InfluenzaA__ADL39401
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcagcugcaugagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 158028 - RNA, 1701 nt, Artificial Sequence
  derived and/or modified sequence opt4 from hemagglutinin__InfluenzaA__ADL39412
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcgagaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 158029 - RNA, 1698 nt, Artificial Sequence
  derived and/or modified sequence opt4 from hemagglutinin__InfluenzaA__ADL39423
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccagccacaccgugaccggcgugagcgccagcugcagccacaacggcgagaacagcuucuacagaaaccugcuguggcugaccggcaagaacggccuguaccccaaccugagcaagagcuacgccaacaacaaggagaaggaggugcuggugcuguggggcgugcaccacccccccaacaucgccgaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagaaccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 158030 - RNA, 1701 nt, Artificial Sequence
  derived and/or modified sequence opt4 from hemagglutinin__InfluenzaA__ADL39434
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugagauucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 158031 - RNA, 1698 nt, Artificial Sequence
  derived and/or modified sequence opt4 from hemagglutinin__InfluenzaA__ADL39445
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccacccugagcaagagcuacgccaacaacaaggagaaggaggugcuggugcuguggggcgugcaccacccccccaacaucguggaccagaagacccuguacagaaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 158032 - RNA, 1698 nt, Artificial Sequence
  derived and/or modified sequence opt4 from hemagglutinin__InfluenzaA__ADL39456
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccagccacaccgugaccggcgugagcgccagcugcagccacaacggcgagaacagcuucuacagaaaccugcuguggcugaccggcaagaacggccuguaccccaaccugagcaagagcuacgccaacaacaaggagaaggaggugcuggugcuguggggcgugcaccacccccccaacaucgccgaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 158033 - RNA, 1698 nt, Artificial Sequence
  derived and/or modified sequence opt4 from hemagglutinin__InfluenzaA__ADL39467
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucguggaccagaagacccuguacagaaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccaugggcaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 158034 - RNA, 1701 nt, Artificial Sequence; identical to SEQ ID NO: 155189
  derived and/or modified sequence opt4 from hemagglutinin__InfluenzaA__ADL41164

SEQ ID NO: 158035 - RNA, 1701 nt, Artificial Sequence; identical to SEQ ID NO: 155282
  derived and/or modified sequence opt4 from hemagglutinin__InfluenzaA__ADL41173

SEQ ID NO: 158036 - RNA, 1698 nt, Artificial Sequence
  derived and/or modified sequence opt4 from hemagglutinin__InfluenzaA__ADL60242
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagaagcuucuacagaaaccugcuguggcugaccggcaagaacggccuguaccccaaccugagcaagagcuacgccaacaacaaggagaaggaggugcuggugcuguggggcgugcaccacccccccgacaucggcaaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 158037 - RNA, 1698 nt, Artificial Sequence
  derived and/or modified sequence opt4 from hemagglutinin__InfluenzaA__ADL60253
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcggccugcugaucagcaaggagagcuggagcuacaucguggagaagcccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcaaccagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 158038 - RNA, 1698 nt, Artificial Sequence; identical to SEQ ID NO: 158036
  derived and/or modified sequence opt4 from hemagglutinin__InfluenzaA__ADL60264

SEQ ID NO: 158039 - RNA, 1698 nt, Artificial Sequence; identical to SEQ ID NO: 158036
  derived and/or modified sequence opt4 from hemagglutinin__InfluenzaA__ADL60275

SEQ ID NO: 158040 - RNA, 1698 nt, Artificial Sequence
  derived and/or modified sequence opt4 from hemagglutinin__InfluenzaA__ADL60286
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccagcaucagcaaccagaagacccuguaccacaccgagaacgccuacgugagcguggugagcagccacuacagcagaaaguucacccccgagguggccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 158041 - RNA, 1698 nt, Artificial Sequence
  derived and/or modified sequence opt4 from hemagglutinin__InfluenzaA__ADL60297
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccagaaagaacggccuguaccccaaccugagcaagagcuacgccaacaacaaggagaaggaggugcuggugcuguggggcgugcaccacccccccaacaucggcgaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacagccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 158042 - RNA, 1698 nt, Artificial Sequence
  derived and/or modified sequence opt4 from hemagglutinin__InfluenzaA__ADL60308
augaaggugaagcugcuggugcugcugugcaccuucgccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgugcagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 158043 - RNA, 1698 nt, Artificial Sequence
  derived and/or modified sequence opt4 from hemagglutinin__InfluenzaA__ADL60341
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgugcagaaggcccuguaccacaccgagaucgccuacgugagcguggugagcagccacuacagcagaaaguucacccccgagaucgccaagagacccaaggugagagaccaggagggcagaaucaacuacuacuggaccauccuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 158044 - RNA, 1698 nt, Artificial Sequence
  derived and/or modified sequence opt4 from hemagglutinin__InfluenzaA__ADL60352
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccggcuacgaggagcugagagagcagcugagcagcgugagcagcuucgagagauucgagaucuuccccaaggagagcagcuggcccaaccacaccgugaccggcgugagcgccagcugcagccacaacggcgagagaagcuucuacagaaaccugcuguggcugaccggcaagaacggccuguaccccaaccugagcaagagcuacgccaacaacaaggagaaggaggugcuggugcuguggggcgugcaccacccccccgacaucggcaaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 158045 - RNA, 1701 nt, Artificial Sequence
  derived and/or modified sequence opt4 from hemagglutinin__InfluenzaA__ADL60363
augaagaccaucaucgcccugagcuacauccugugccugguguucgcccagaaguuccccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaacugggaccuguucguggagagaagcaaggccuacagcaacugcuaccccuacgacgugcccgacuacgccagccugagaagccugaucgccagcagcggcacccuggaguucaacaacgagagcuucaacuggaccggcgugacccagaacggcaccagcagcgccugcaucagaagaagcaacaacagcuucuucagcagacugaacuggcugacccacagcaaguucaaguaccccgcccugaacgugaccaugcccaacaacgagaacuucgacaagcuguacaucuggggcgugcaccaccccggcaccgacaacgaccagaucuuccuguacgcccaggccagcggcagaaucaccaucagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcgugggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgcccugcugggcuucaucaugugggccugccagaagggcaacaucagaugcaacaucugcaucuga

SEQ ID NO: 158046 - RNA, 1698 nt, Artificial Sequence
  derived and/or modified sequence opt4 from hemagglutinin__InfluenzaA__ADL60374
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacgacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaguggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 158047 - RNA, 1701 nt, Artificial Sequence
  derived and/or modified sequence opt4 from hemagglutinin__InfluenzaA__ADM07135
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgagagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158048 - RNA, 1701 nt, Artificial Sequence; identical to SEQ ID NO: 155674
  derived and/or modified sequence opt4 from hemagglutinin__InfluenzaA__ADM07144

SEQ ID NO: 158049 - RNA, 1701 nt, Artificial Sequence
  derived and/or modified sequence opt4 from hemagglutinin__InfluenzaA__ADM07154
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccacccccccaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggugagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158050 - RNA, 1701 nt, Artificial Sequence; identical to SEQ ID NO: 155674
  derived and/or modified sequence opt4 from hemagglutinin__InfluenzaA__ADM07163

SEQ ID NO: 158051 - RNA, 1698 nt, Artificial Sequence; identical to SEQ ID NO: 158033
  derived and/or modified sequence opt4 from hemagglutinin__InfluenzaA__ADM07460

SEQ ID NO: 158052 - RNA, 1701 nt, Artificial Sequence
  derived and/or modified sequence opt4 from hemagglutinin__InfluenzaA__ADM07504
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 158053 - RNA, 1701 nt, Artificial Sequence
  derived and/or modified sequence opt4 from hemagglutinin__InfluenzaA__ADM12806
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaccaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 158054 - RNA, 1701 nt, Artificial Sequence; identical to SEQ ID NO: 158053
  derived and/or modified sequence opt4 from hemagglutinin__InfluenzaA__ADM12817

SEQ ID NO: 158055 - RNA, 1701 nt, Artificial Sequence; identical to SEQ ID NO: 158053
  derived and/or modified sequence opt4 from hemagglutinin__InfluenzaA__ADM12828

SEQ ID NO: 158056 - RNA, 1701 nt, Artificial Sequence; identical to SEQ ID NO: 158053
  derived and/or modified sequence opt4 from hemagglutinin__InfluenzaA__ADM12839

SEQ ID NO: 158057 - RNA, 1701 nt, Artificial Sequence
  derived and/or modified sequence opt4 from hemagglutinin__InfluenzaA__ADM12850
augaaggccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaccaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 158058 - RNA, 1701 nt, Artificial Sequence; identical to SEQ ID NO: 155189
  derived and/or modified sequence opt4 from hemagglutinin__InfluenzaA__ADM12861

SEQ ID NO: 158059 - RNA, 1701 nt, Artificial Sequence; identical to SEQ ID NO: 155189
  derived and/or modified sequence opt4 from hemagglutinin__InfluenzaA__ADM12871

SEQ ID NO: 158060 - RNA, 1701 nt, Artificial Sequence; identical to SEQ ID NO: 155189
  derived and/or modified sequence opt4 from hemagglutinin__InfluenzaA__ADM12881

SEQ ID NO: 158061 - RNA, 1701 nt, Artificial Sequence; identical to SEQ ID NO: 155189
  derived and/or modified sequence opt4 from hemagglutinin__InfluenzaA__ADM12891

SEQ ID NO: 158062 - RNA, 1701 nt, Artificial Sequence; identical to SEQ ID NO: 155189
  derived and/or modified sequence opt4 from hemagglutinin__InfluenzaA__ADM12901

SEQ ID NO: 158063 - RNA, 1701 nt, Artificial Sequence; identical to SEQ ID NO: 156291
  derived and/or modified sequence opt4 from hemagglutinin__InfluenzaA__ADM12911

SEQ ID NO: 158064 - RNA, 1701 nt, Artificial Sequence; identical to SEQ ID NO: 155189
  derived and/or modified sequence opt4 from hemagglutinin__InfluenzaA__ADM12921

SEQ ID NO: 158065 - RNA, 1701 nt, Artificial Sequence; identical to SEQ ID NO: 155189
  derived and/or modified sequence opt4 from hemagglutinin__InfluenzaA__ADM12931

SEQ ID NO: 158066 - RNA, 1701 nt, Artificial Sequence; identical to SEQ ID NO: 155189
  derived and/or modified sequence opt4 from hemagglutinin__InfluenzaA__ADM12941

SEQ ID NO: 158067 - RNA, 1701 nt, Artificial Sequence; identical to SEQ ID NO: 155189
  derived and/or modified sequence opt4 from hemagglutinin__InfluenzaA__ADM12951

SEQ ID NO: 158068 - RNA, 1701 nt, Artificial Sequence
  derived and/or modified sequence opt4 from hemagglutinin__InfluenzaA__ADM12961
augaaggccgugcugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugggcggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158069 - RNA, 1701 nt, Artificial Sequence; identical to SEQ ID NO: 156838
  derived and/or modified sequence opt4 from hemagglutinin__InfluenzaA__ADM12971

SEQ ID NO: 158070 - RNA, 1701 nt, Artificial Sequence; identical to SEQ ID NO: 156290
  derived and/or modified sequence opt4 from hemagglutinin__InfluenzaA__ADM12981

SEQ ID NO: 158071 - RNA, 1701 nt, Artificial Sequence
  derived and/or modified sequence opt4 from hemagglutinin__InfluenzaA__ADM12991
augaaggccauccugguggugcugcuguacaccuucgagaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagcacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158072 - RNA, 1701 nt, Artificial Sequence
  derived and/or modified sequence opt4 from hemagglutinin__InfluenzaA__ADM13001
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagcacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158073 - RNA, 1701 nt, Artificial Sequence; identical to SEQ ID NO: 156353
  derived and/or modified sequence opt4 from hemagglutinin__InfluenzaA__ADM13011

SEQ ID NO: 158074 - RNA, 1701 nt, Artificial Sequence
  derived and/or modified sequence opt4 from hemagglutinin__InfluenzaA__ADM13021
augaaggccauccugguggugcugcuguacaccuucgccaccgccaacgccgacacccugugcaucggcuaccacgccaacaacagcaccgacaccaucgacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158075 - RNA, 1701 nt, Artificial Sequence; identical to SEQ ID NO: 156535
  derived and/or modified sequence opt4 from hemagglutinin__InfluenzaA__ADM13031

SEQ ID NO: 158076 - RNA, 1701 nt, Artificial Sequence
  derived and/or modified sequence opt4 from hemagglutinin__InfluenzaA__ADM13041
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacgugcaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158077 - RNA, 1701 nt, Artificial Sequence
  derived and/or modified sequence opt4 from hemagglutinin__InfluenzaA__ADM13051
augaaggccauccugguggugcugcuguacaccuucgccaccaccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158078 - RNA, 1701 nt, Artificial Sequence
  derived and/or modified sequence opt4 from hemagglutinin__InfluenzaA__ADM13061
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcaucgccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccagcugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158079 - RNA, 1701 nt, Artificial Sequence; identical to SEQ ID NO: 157356
  derived and/or modified sequence opt4 from hemagglutinin__InfluenzaA__ADM13071

SEQ ID NO: 158080 - RNA, 1701 nt, Artificial Sequence
  derived and/or modified sequence opt4 from hemagglutinin__InfluenzaA__ADM13081
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcaucgccccccugcaccugggcaagugcaacaucgccggcuggauccugggcaaccccgagugcgagagccugagcaccgccagcagcuggagcuacaucguggagaccagcggcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaaggagaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158081 - RNA, 1701 nt, Artificial Sequence; identical to SEQ ID NO: 156609
  derived and/or modified sequence opt4 from hemagglutinin__InfluenzaA__ADM13091

SEQ ID NO: 158082 - RNA, 1701 nt, Artificial Sequence; identical to SEQ ID NO: 156353
  derived and/or modified sequence opt4 from hemagglutinin__InfluenzaA__ADM13101

SEQ ID NO: 158083 - RNA, 1701 nt, Artificial Sequence
  derived and/or modified sequence opt4 from hemagglutinin__InfluenzaA__ADM13111
augaaggccauccugguggugcugcuguacaccuucgagaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggaccccggcgacaagaucaccuucgaggccaccggcaaccugguggugcccagauacgccuucgccauggagagaaacgccggcagcggcaucaucaucagcgacacccccgugcacgacugcaacaccaccugccagacccccaacggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158084 - RNA, 1701 nt, Artificial Sequence; identical to SEQ ID NO: 155189
  derived and/or modified sequence opt4 from hemagglutinin__InfluenzaA__ADM13121

SEQ ID NO: 158085 - RNA, 1701 nt, Artificial Sequence; identical to SEQ ID NO: 156353
  derived and/or modified sequence opt4 from hemagglutinin__InfluenzaA__ADM13131

SEQ ID NO: 158086 - RNA, 1701 nt, Artificial Sequence; identical to SEQ ID NO: 156517
  derived and/or modified sequence opt4 from hemagglutinin__InfluenzaA__ADM13141

SEQ ID NO: 158087 - RNA, 1701 nt, Artificial Sequence; identical to SEQ ID NO: 156517
  derived and/or modified sequence opt4 from hemagglutinin__InfluenzaA__ADM13151

SEQ ID NO: 158088 - RNA, 1701 nt, Artificial Sequence; identical to SEQ ID NO: 156290
  derived and/or modified sequence opt4 from hemagglutinin__InfluenzaA__ADM13161

SEQ ID NO: 158089 - RNA, 1701 nt, Artificial Sequence; identical to SEQ ID NO: 156838
  derived and/or modified sequence opt4 from hemagglutinin__InfluenzaA__ADM13171

SEQ ID NO: 158090 - RNA, 1701 nt, Artificial Sequence; identical to SEQ ID NO: 156838
  derived and/or modified sequence opt4 from hemagglutinin__InfluenzaA__ADM13181

SEQ ID NO: 158091 - RNA, 1701 nt, Artificial Sequence
  derived and/or modified sequence opt4 from hemagglutinin__InfluenzaA__ADM13191
augaaggccauccugguggugcugcuguacacccuggccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagcacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158092 - RNA, 1701 nt, Artificial Sequence
  derived and/or modified sequence opt4 from hemagglutinin__InfluenzaA__ADM13211
augaaggccauccugguggugcugcuguacacccuggccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcaucgccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158093 - RNA, 1701 nt, Artificial Sequence; identical to SEQ ID NO: 158092
  derived and/or modified sequence opt4 from hemagglutinin__InfluenzaA__ADM13221

SEQ ID NO: 158094 - RNA, 1701 nt, Artificial Sequence
  derived and/or modified sequence opt4 from hemagglutinin__InfluenzaA__ADM13231
augaaggccauccugguggugcugcuguacaccuucgagaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaacggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158095 - RNA, 1701 nt, Artificial Sequence; identical to SEQ ID NO: 156353
  derived and/or modified sequence opt4 from hemagglutinin__InfluenzaA__ADM13241

SEQ ID NO: 158096 - RNA, 1701 nt, Artificial Sequence
  derived and/or modified sequence opt4 from hemagglutinin__InfluenzaA__ADM13251
augaaggccauccugguggugcugcuguacaccuucgccaccaccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagagacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158097 - RNA, 1701 nt, Artificial Sequence
  derived and/or modified sequence opt4 from hemagglutinin__InfluenzaA__ADM13261
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcaucgccccccugcaccugggcaagugcaacaucgccggcuggauccugggcaaccccgagugcgagagccugagcaccgccagcagcuggagcuacaucguggagaccagcggcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158098 - RNA, 1701 nt, Artificial Sequence
  derived and/or modified sequence opt4 from hemagglutinin__InfluenzaA__ADM13271
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaauccaccagauccuggccaucuacagcaccguggccagcagccuggugcugguggugagccugggcgccaucagcuucuggaugugcagcaacggcagccugcagugcagaaucugcaucuga

SEQ ID NO: 158099 - RNA, 1701 nt, Artificial Sequence; identical to SEQ ID NO: 158094
  derived and/or modified sequence opt4 from hemagglutinin__InfluenzaA__ADM13281

SEQ ID NO: 158100 - RNA, 1701 nt, Artificial Sequence; identical to SEQ ID NO: 156290
  derived and/or modified sequence opt4 from hemagglutinin__InfluenzaA__ADM13291

SEQ ID NO: 158101 - RNA, 1701 nt, Artificial Sequence
  derived and/or modified sequence opt4 from hemagglutinin__InfluenzaA__ADM13301
augaaggccauccugguggugcugcuguacaccuucgccaccgccaacgccgacacccugugcaucggcuaccacgccaacaacagcaccgacaccguggacaccauccuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaaggagaacagcuaccccaagcugagcaagagcuacaucaacgacaagggcaaggaggugcuggugcuguggggcauccaccaccccagcaccagcgccgaccagcagagccuguaccagaacguggacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158102 - RNA, 1701 nt, Artificial Sequence
  derived and/or modified sequence opt4 from hemagglutinin__InfluenzaA__ADM13311
augaaggccauccugguggugcugcuguacaccuucgccaccgccaacgccgacacccugugcaucggcuaccacgccaacaacagcaccgacaccguggacaccauccuggagaagaacgugaccgugacccacagcgugaaccugcuggagaacaagcacaacggcaagcugugcaagcugagaggcgugagcccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccgccgccagcagccuggugcugguggugagccugggcgccaucagcuucuggaugugcagcaacggcagccugcagugcagaaucugcaucuga

SEQ ID NO: 158103 - RNA, 1701 nt, Artificial Sequence; identical to SEQ ID NO: 156353
  derived and/or modified sequence opt4 from hemagglutinin__InfluenzaA__ADM13321

SEQ ID NO: 158104 - RNA, 1701 nt, Artificial Sequence
  derived and/or modified sequence opt4 from hemagglutinin__InfluenzaA__ADM13331
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccgaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158105 - RNA, 1701 nt, Artificial Sequence; identical to SEQ ID NO: 156802
  derived and/or modified sequence opt4 from hemagglutinin__InfluenzaA__ADM13341

SEQ ID NO: 158106 - RNA, 1701 nt, Artificial Sequence; identical to SEQ ID NO: 157768
  derived and/or modified sequence opt4 from hemagglutinin__InfluenzaA__ADM13351

SEQ ID NO: 158107 - RNA, 1701 nt, Artificial Sequence; identical to SEQ ID NO: 154849
  derived and/or modified sequence opt4 from hemagglutinin__InfluenzaA__ADM13442

SEQ ID NO: 158108 - RNA, 1701 nt, Artificial Sequence; identical to SEQ ID NO: 154849
  derived and/or modified sequence opt4 from hemagglutinin__InfluenzaA__ADM13443

SEQ ID NO: 158109 - RNA, 1701 nt, Artificial Sequence; identical to SEQ ID NO: 154849
  derived and/or modified sequence opt4 from hemagglutinin__InfluenzaA__ADM13444

SEQ ID NO: 158110 - RNA, 1701 nt, Artificial Sequence; identical to SEQ ID NO: 155796
  derived and/or modified sequence opt4 from hemagglutinin__InfluenzaA__ADM13445

SEQ ID NO: 158111 - RNA, 1701 nt, Artificial Sequence; identical to SEQ ID NO: 154849
  derived and/or modified sequence opt4 from hemagglutinin__InfluenzaA__ADM13446

SEQ ID NO: 158112 - RNA, 1701 nt, Artificial Sequence
  derived and/or modified sequence opt4 from hemagglutinin__InfluenzaA__ADM13447
augaagaccaucaucgcccugagcuacaucuucugccuggcccugggccaggaccugcccggcaacgacaacagcaccgccacccugugccugggccaccacgccgugcccaacggcacccuggugaagaccaucaccgacgaccagaucgaggugaccaacgccaccgagcuggugcagagcagcagcaccggcaagaucugcaacaacccccacagaauccuggacggcaucgacugcacccugaucgacgcccugcugggcgacccccacugcgacguguuccagaacgagaccugggaccuguucguggagagaagcaaggccuucagcaacugcuaccccuacgacgugcccgacuacgccagccugagaagccugguggccagcagcggcacccuggaguucaucaccgagggcuucaccuggaccggcgugacccagaacggcggcagcaacgccugcaagagaggccccggcagcggcuucuucagcagacugaacuggcugaccaagagcggcagcaccuacagcgugcugaacgugaccaugcccaacaacgacaacuucgacaagcuguacaucuggggcgugcaccaccccagcaccaaccaggagcagaccagccuguacgugcaggccagcggcagagugaccgugagcaccagaagaagccagcagaccaucauccccaacaucggcagcagacccugggugagaggccugagcagcagaaucagcaucuacuggaccaucgugaagcccggcgacgugcuggugaucaacagcaacggcaaccugaucgcccccagaggcuacuucaagaugagaaccggcaagagcagcaucaugagaagcgacgcccccaucgacaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggccuguucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucgagagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagagaggcaacaucagaugcaacaucugcaucuga

SEQ ID NO: 158113 - RNA, 1701 nt, Artificial Sequence; identical to SEQ ID NO: 154919
  derived and/or modified sequence opt4 from hemagglutinin__InfluenzaA__ADM13448

SEQ ID NO: 158114 - RNA, 1701 nt, Artificial Sequence
  derived and/or modified sequence opt4 from hemagglutinin__InfluenzaA__ADM13449
augaagaccaucaucgcccugagcuacaucuucugccuggccuucggccaggaccugcccggcaacgacaacagcaccgccacccugugccugggccaccacgccgugcccaacggcacccuggugaagaccaucaccgacgaccagaucgaggugaccaacgccaccgagcuggugcagagcagcagcaccggcaagaucugcaacaacccccacagaauccuggacggcaucgacugcacccugaucgacgcccugcugggcgacccccacugcgacguguuccagaacgagaccugggaccuguucguggagagaagcaaggccuucagcaacugcuaccccuacgacgugcccgacuacgccagccugagaagccugguggccagcagcggcacccuggaguucaucaccgagggcuucaccuggaccggcgugacccagaacggcggcagcaacgccugcaagagaggccccggcagcggcuucuucagcagacugaacuggcugaccaagagcggcagcaccuaccccgugcugaacgugaccaugcccaacaacgacaacuucgacaagcuguacaucuggggcgugcaccaccccagcaccaaccaggagcagaccagccuguacgugcaggccagcggcagagugaccgugagcaccagaagaagccagcagaccaucauccccaacaucgagagcagacccugggugagaggccugagcagcagaaucagcaucuacuggaccaucgugaaccccggcgacgugcuggugaucaacagcaacggcaaccugaucgcccccagaggcuacuucaagaugagaaccggcaagagcagcaucaugagaagcgacgcccccaucgacaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggccuguucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucgagagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagagaggcaacaucagaugcaacaucugcaucuga

SEQ ID NO: 158115 - RNA, 1701 nt, Artificial Sequence; identical to SEQ ID NO: 154951
  derived and/or modified sequence opt4 from hemagglutinin__InfluenzaA__ADM13450

SEQ ID NO: 158116 - RNA, 1701 nt, Artificial Sequence
  derived and/or modified sequence opt4 from hemagglutinin__InfluenzaA__ADM13451
augaagaccaucaucgcccugagcuacaucuucugccuggcccugggccaggaccugcccggcaacgacaacagaaccgccacccugugccugggccaccacgccgugcccaacggcacccuggugaagaccaucaccgacgaccagaucgaggugaccaacgccaccgagcuggugcagagcagcagcaccggcaagaucugcaacaacccccacagaauccuggacggcaucgacugcacccugaucgacgcccugcugggcgacccccacugcgacguguuccagaacgagaccugggaccuguucguggagagaagcaaggccuucagcaacugcuaccccuacgacgugcccgacuacgccagccugagaagccugguggccagcagcggcacccuggaguucaucaccgagggcuucaccuggaccggcgugacccagaacggcggcagcaacgccugcaagagaggccccggcagcggcuucuucagcagacugaacuggcugaccaagagcggcagcaccuaccccgugcugaacgugaccaugcccaacaacgacaacuucgacaagcuguacaucuggggcgugcaccaccccagcaccaaccaggagcagaccagccuguacgugcaggccagcggcagagugaccgugagcaccagaagaagccagcagaccaucauccccaacaucggcagcagacccugggugagaggccugagcagcagaaucagcaucuacuggaccaucgugaagcccggcgacgugcuggugaucaacagcaacggcaaccugaucgcccccagaggcuacuucaagaugagaaccggcaagagcagcaucaugagaagcgacgcccccaucgacaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggccuguucggcgccaucgccggcuucaucgagaacggcugggagggcaugaucgacggcugguacggcuucagacaccagaacagcgagggcaccggccaggccgccgaccugaagagcacccaggccaccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucgagagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagagaggcaacaucagaugcaacaucugcaucuga

SEQ ID NO: 158117 - RNA, 1701 nt, Artificial Sequence; identical to SEQ ID NO: 154836
  derived and/or modified sequence opt4 from hemagglutinin__InfluenzaA__ADM13452

SEQ ID NO: 158118 - RNA, 1701 nt, Artificial Sequence
  derived and/or modified sequence opt4 from hemagglutinin__InfluenzaA__ADM14467
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcagccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagagcauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158119 - RNA, 1695 nt, Artificial Sequence
  derived and/or modified sequence opt4 from hemagglutinin__InfluenzaA__ADM14516
augaaggccauccugguggugcugcuguacaccuucgccaccgccaacgccgacacccugugcaucggcuaccacgccaacaacagcaccgacaccgugaacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcaccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcggccacagcugcagaaucugcaucuga

SEQ ID NO: 158120 - RNA, 1701 nt, Artificial Sequence
  derived and/or modified sequence opt4 from hemagglutinin__InfluenzaA__ADM14525
augaaggccacccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagccugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggacgugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158121 - RNA, 1695 nt, Artificial Sequence
  derived and/or modified sequence opt4 from hemagglutinin__InfluenzaA__ADM14553
augaaggccauccugguggugcugcuguacaccuucgccaccgccaacgccgacacccugugcaucggcuaccacgccaacaacagcaccgacaccguggacaccauccuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucguggagaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacaccagcgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcggccacagcugcagaaucugcaucuga

SEQ ID NO: 158122 - RNA, 1701 nt, Artificial Sequence; identical to SEQ ID NO: 155636
  derived and/or modified sequence opt4 from hemagglutinin__InfluenzaA__ADM14562

SEQ ID NO: 158123 - RNA, 1701 nt, Artificial Sequence; identical to SEQ ID NO: 155189
  derived and/or modified sequence opt4 from hemagglutinin__InfluenzaA__ADM14571

SEQ ID NO: 158124 - RNA, 1701 nt, Artificial Sequence
  derived and/or modified sequence opt4 from hemagglutinin__InfluenzaA__ADM14580
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagaagaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucaacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158125 - RNA, 1701 nt, Artificial Sequence
  derived and/or modified sequence opt4 from hemagglutinin__InfluenzaA__ADM14589
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagaagaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacggccagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucaacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158126 - RNA, 1701 nt, Artificial Sequence
  derived and/or modified sequence opt4 from hemagglutinin__InfluenzaA__ADM14599
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgugaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158127 - RNA, 1701 nt, Artificial Sequence; identical to SEQ ID NO: 156349
  derived and/or modified sequence opt4 from hemagglutinin__InfluenzaA__ADM14609

SEQ ID NO: 158128 - RNA, 1701 nt, Artificial Sequence
  derived and/or modified sequence opt4 from hemagglutinin__InfluenzaA__ADM14618
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacaaccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158129 - RNA, 1701 nt, Artificial Sequence; identical to SEQ ID NO: 155189
  derived and/or modified sequence opt4 from hemagglutinin__InfluenzaA__ADM14627

SEQ ID NO: 158130 - RNA, 1701 nt, Artificial Sequence
  derived and/or modified sequence opt4 from hemagglutinin__InfluenzaA__ADM14655
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugagaagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158131 - RNA, 1701 nt, Artificial Sequence
  derived and/or modified sequence opt4 from hemagglutinin__InfluenzaA__ADM14664
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaacggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158132 - RNA, 1701 nt, Artificial Sequence; identical to SEQ ID NO: 155189
  derived and/or modified sequence opt4 from hemagglutinin__InfluenzaA__ADM14673

SEQ ID NO: 158133 - RNA, 1701 nt, Artificial Sequence; identical to SEQ ID NO: 155189
  derived and/or modified sequence opt4 from hemagglutinin__InfluenzaA__ADM14682

SEQ ID NO: 158134 - RNA, 1701 nt, Artificial Sequence; identical to SEQ ID NO: 155189
  derived and/or modified sequence opt4 from hemagglutinin__InfluenzaA__ADM14691

SEQ ID NO: 158135 - RNA, 1701 nt, Artificial Sequence; identical to SEQ ID NO: 156353
  derived and/or modified sequence opt4 from hemagglutinin__InfluenzaA__ADM14700

SEQ ID NO: 158136 - RNA, 1695 nt, Artificial Sequence
  derived and/or modified sequence opt4 from hemagglutinin__InfluenzaA__ADM14709
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccaacagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcaaguacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacggcaucaccaacaagaucaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccugaacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcggccacagcugcagaaucugcaucuga

SEQ ID NO: 158137 - RNA, 1701 nt, Artificial Sequence
  derived and/or modified sequence opt4 from hemagglutinin__InfluenzaA__ADM14718
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcaugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158138 - RNA, 1695 nt, Artificial Sequence
  derived and/or modified sequence opt4 from hemagglutinin__InfluenzaA__ADM14728
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaacagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgcccacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcggccacagcugcagaaucugcaucuga

SEQ ID NO: 158139 - RNA, 1701 nt, Artificial Sequence
  derived and/or modified sequence opt4 from hemagglutinin__InfluenzaA__ADM14737
augaaggccauccugguggugcugcuguacaccuucgccaccgccaacgccgacacccugugcaucggcuaccacgccaacaacagcaccgacaccgugaacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagaagaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158140 - RNA, 1701 nt, Artificial Sequence
  derived and/or modified sequence opt4 from hemagglutinin__InfluenzaA__ADM14746
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcugggugcugggcaaccccgagugcgagagccugagcaccgccagcagcuggagcuacaucguggagacccccagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaagaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158141 - RNA, 1695 nt, Artificial Sequence
  derived and/or modified sequence opt4 from hemagglutinin__InfluenzaA__ADM14756
augaaggccauccugguggugcugcuguacaccuucgccaccgccaacgccgacacccugugcgugggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcggccacagcugcagaaucugcaucuga

SEQ ID NO: 158142 - RNA, 1701 nt, Artificial Sequence; identical to SEQ ID NO: 156353
  derived and/or modified sequence opt4 from hemagglutinin__InfluenzaA__ADM14765

SEQ ID NO: 158143 - RNA, 1695 nt, Artificial Sequence
  derived and/or modified sequence opt4 from hemagglutinin__InfluenzaA__ADM14775
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugaacaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcgagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcggccacagcugcagaaucugcaucuga

SEQ ID NO: 158144 - RNA, 1695 nt, Artificial Sequence
  derived and/or modified sequence opt4 from hemagglutinin__InfluenzaA__ADM14802
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagaucagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcggccacagcugcagaaucugcaucuga

SEQ ID NO: 158145 - RNA, 1704 nt, Artificial Sequence
  derived and/or modified sequence opt4 from hemagglutinin__InfluenzaA__ADM14830
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagcugcugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccgagagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaagcuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcggccacagcugccugcagugcagaaucugcaucuga

SEQ ID NO: 158146 - RNA, 1695 nt, Artificial Sequence
  derived and/or modified sequence opt4 from hemagglutinin__InfluenzaA__ADM14848
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcggccacagcugcagaaucugcaucuga

SEQ ID NO: 158147 - RNA, 1695 nt, Artificial Sequence
  derived and/or modified sequence opt4 from hemagglutinin__InfluenzaA__ADM14866
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcgacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaucaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcggccacagcugcagaaucugcaucuga

SEQ ID NO: 158148 - RNA, 1695 nt, Artificial Sequence
  derived and/or modified sequence opt4 from hemagglutinin__InfluenzaA__ADM14876
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaaggagaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcggccacagcugcagaaucugcaucuga

SEQ ID NO: 158149 - RNA, 1704 nt, Artificial Sequence
  derived and/or modified sequence opt4 from hemagglutinin__InfluenzaA__ADM14885
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagcugcugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaaggagaaggaggugcuggugcuguggggcauccaccaccccagcaccagcgccgaccagcagagccuguaccagaacgccgacgccuacguguucgugggcaccagcagauacagcaagaaguucaagcccgagaucgugaucagacccaaggugagagaccaggagggcagaaugaacuacuacuggacccugguggagcccggcgacaagaucaccuucgaggccaccggcaaccugguggugcccagauacgccuucgccauggagagaaacgccgagagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaagcuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcggccacggcagccugcagugcagaaucugcaucuga

SEQ ID NO: 158150 - RNA, 1695 nt, Artificial Sequence
  derived and/or modified sequence opt4 from hemagglutinin__InfluenzaA__ADM14894
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaaggagaaggaggugcuggugcuguggggcauccaccaccccagcaccagcgccgaccagcagagccuguaccagaacgccgacgccuacguguucgugggcaccagcagauacagcaagaaguucaagcccgagaucgugaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucgugaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaagcuguacgagaaggugagaagccagcugaagaacaacgccaaggagaucggcaacggcugcuucgaguucuaccacaagugcgacaacaccugcaugaagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcggccacagcugcagaaucugcaucuga

SEQ ID NO: 158151 - RNA, 1695 nt, Artificial Sequence
  derived and/or modified sequence opt4 from hemagglutinin__InfluenzaA__ADM14903
augaaggccauccugguggugcugcugugcaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcggccacagcugcagaaucugcaucuga

SEQ ID NO: 158152 - RNA, 1695 nt, Artificial Sequence
  derived and/or modified sequence opt4 from hemagglutinin__InfluenzaA__ADM14912
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcggccacagcugcagaaucugcaucuga

SEQ ID NO: 158153 - RNA, 1695 nt, Artificial Sequence
  derived and/or modified sequence opt4 from hemagglutinin__InfluenzaA__ADM14921
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcggccacagcugcagaaucugcaucuga

SEQ ID NO: 158154 - RNA, 1701 nt, Artificial Sequence; identical to SEQ ID NO: 156353
  derived and/or modified sequence opt4 from hemagglutinin__InfluenzaA__ADM14930

SEQ ID NO: 158155 - RNA, 1701 nt, Artificial Sequence
  derived and/or modified sequence opt4 from hemagglutinin__InfluenzaA__ADM14948
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcagaaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158156 - RNA, 1695 nt, Artificial Sequence
  derived and/or modified sequence opt4 from hemagglutinin__InfluenzaA__ADM14966
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcggccacagcugcagaaucugcaucuga

SEQ ID NO: 158157 - RNA, 1701 nt, Artificial Sequence; identical to SEQ ID NO: 155369
  derived and/or modified sequence opt4 from hemagglutinin__InfluenzaA__ADM14975

SEQ ID NO: 158158 - RNA, 1701 nt, Artificial Sequence
  derived and/or modified sequence opt4 from hemagglutinin__InfluenzaA__ADM14985
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaaggagaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagaggccaggagggcagaaugaacuacuacuggacccugguggagcccggcgacaagaucaccuucgaggccaccggcaaccugguggugcccagauacgccuucgccauggagagaaacgccggcagcggcaucgugaucagcgacacccccgugcacgacugcaacaccaccugccagacccccaagggcgccaucaacaccagccugcccuuccagaacauccacagcaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158159 - RNA, 1701 nt, Artificial Sequence
  derived and/or modified sequence opt4 from hemagglutinin__InfluenzaA__ADM23841
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccagagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158160 - RNA, 1701 nt, Artificial Sequence; identical to SEQ ID NO: 156353
  derived and/or modified sequence opt4 from hemagglutinin__InfluenzaA__ADM23843

SEQ ID NO: 158161 - RNA, 1701 nt, Artificial Sequence
  derived and/or modified sequence opt4 from hemagglutinin__InfluenzaA__ADM23844
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcaucagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccaccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccagagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158162 - RNA, 1701 nt, Artificial Sequence
  derived and/or modified sequence opt4 from hemagglutinin__InfluenzaA__ADM23845
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcaucagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccaccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccagagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158163 - RNA, 1701 nt, Artificial Sequence
  derived and/or modified sequence opt4 from hemagglutinin__InfluenzaA__ADM23846
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcaucagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccaccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158164 - RNA, 1701 nt, Artificial Sequence
  derived and/or modified sequence opt4 from hemagglutinin__InfluenzaA__ADM23847
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcaucagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccaccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccagagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgugggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158165 - RNA, 1701 nt, Artificial Sequence
  derived and/or modified sequence opt4 from hemagglutinin__InfluenzaA__ADM23849
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccagagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158166 - RNA, 1701 nt, Artificial Sequence
  derived and/or modified sequence opt4 from hemagglutinin__InfluenzaA__ADM23851
auggaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccagagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccacaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158167 - RNA, 1701 nt, Artificial Sequence
  derived and/or modified sequence opt4 from hemagglutinin__InfluenzaA__ADM23852
auggaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccacaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158168 - RNA, 1701 nt, Artificial Sequence; identical to SEQ ID NO: 158167
  derived and/or modified sequence opt4 from hemagglutinin__InfluenzaA__ADM23853

SEQ ID NO: 158169 - RNA, 1701 nt, Artificial Sequence; identical to SEQ ID NO: 155431
  derived and/or modified sequence opt4 from hemagglutinin__InfluenzaA__ADM23855

SEQ ID NO: 158170 - RNA, 1701 nt, Artificial Sequence
  derived and/or modified sequence opt4 from hemagglutinin__InfluenzaA__ADM23856
augaaggccauccugguggugcugcuguacaccuucgccaccgugaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagagaaaggaggugcuggugcuguggggcauccaccaccagagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158171 - RNA, 1701 nt, Artificial Sequence; identical to SEQ ID NO: 155189
  derived and/or modified sequence opt4 from hemagglutinin__InfluenzaA__ADM25945

SEQ ID NO: 158172 - RNA, 1701 nt, Artificial Sequence; identical to SEQ ID NO: 155431
  derived and/or modified sequence opt4 from hemagglutinin__InfluenzaA__ADM25948

SEQ ID NO: 158173 - RNA, 1701 nt, Artificial Sequence; identical to SEQ ID NO: 157218
  derived and/or modified sequence opt4 from hemagglutinin__InfluenzaA__ADM26264

SEQ ID NO: 158174 - RNA, 1701 nt, Artificial Sequence; identical to SEQ ID NO: 157218
  derived and/or modified sequence opt4 from hemagglutinin__InfluenzaA__ADM26265

SEQ ID NO: 158175 - RNA, 1701 nt, Artificial Sequence; identical to SEQ ID NO: 157218
  derived and/or modified sequence opt4 from hemagglutinin__InfluenzaA__ADM26266

SEQ ID NO: 158176 - RNA, 1701 nt, Artificial Sequence; identical to SEQ ID NO: 157218
  derived and/or modified sequence opt4 from hemagglutinin__InfluenzaA__ADM26267

SEQ ID NO: 158177 - RNA, 1701 nt, Artificial Sequence
  derived and/or modified sequence opt4 from hemagglutinin__InfluenzaA__ADM26268
augaaggccauccugguggugcugcuguacaccuucaccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccacagcaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaagagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158178 - RNA, 1701 nt, Artificial Sequence
  derived and/or modified sequence opt4 from hemagglutinin__InfluenzaA__ADM26269
augaagaccauccugguggugcugcuguacaccuucaccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccacagcaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaagagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158179 - RNA, 1701 nt, Artificial Sequence
  derived and/or modified sequence opt4 from hemagglutinin__InfluenzaA__ADM26270
augaaggccauccugguggugcugcuguacaccuucaccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccacagcaucaccaucggcagaugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggaccaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158180 - RNA, 1701 nt, Artificial Sequence; identical to SEQ ID NO: 157218
  derived and/or modified sequence opt4 from hemagglutinin__InfluenzaA__ADM26271

SEQ ID NO: 158181 - RNA, 1701 nt, Artificial Sequence
  derived and/or modified sequence opt4 from hemagglutinin__InfluenzaA__ADM26272
augaaggccauccugguggugcugcuguacaccuucaccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccacagcaucaccaucggcagaugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158182 - RNA, 1701 nt, Artificial Sequence
  derived and/or modified sequence opt4 from hemagglutinin__InfluenzaA__ADM26274
augaaggccauccugguggugcugcuguacaccuucaccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccacagcaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaaggaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158183 - RNA, 1701 nt, Artificial Sequence; identical to SEQ ID NO: 157218
  derived and/or modified sequence opt4 from hemagglutinin__InfluenzaA__ADM26276

SEQ ID NO: 158184 - RNA, 1701 nt, Artificial Sequence
  derived and/or modified sequence opt4 from hemagglutinin__InfluenzaA__ADM26277
augaaggccauccugguggugcugcuguacaccuucaccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccacagcaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugaucgugagccugggcgccaucagcuucuggaugugcagcaacggcagccugcagugcagaaucugcaucuga

SEQ ID NO: 158185 - RNA, 1701 nt, Artificial Sequence
  derived and/or modified sequence opt4 from hemagglutinin__InfluenzaA__ADM26278
augaaggccauccugguggugcugcuguacaccuucaccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacgugagcgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauucgccuucgccauggagagaaacgccggcagcggcaucaucaucagcgacacccccgugcacgacugcaacaccaccugccagacccccaagggcgccaucaacaccagccugcccuuccagaacauccacagcaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaagagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158186 - RNA, 1701 nt, Artificial Sequence
  derived and/or modified sequence opt4 from hemagglutinin__InfluenzaA__ADM26279
augaaggccauccugguggugcugcuguacaccuucaccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagaggccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccacagcaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158187 - RNA, 1701 nt, Artificial Sequence; identical to SEQ ID NO: 157218
  derived and/or modified sequence opt4 from hemagglutinin__InfluenzaA__ADM26280

SEQ ID NO: 158188 - RNA, 1701 nt, Artificial Sequence
  derived and/or modified sequence opt4 from hemagglutinin__InfluenzaA__ADM26281
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagagcauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagagaagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaguguaccagauccuggccaucuacagcaccguggccagcagccuggugcugguggugagccugggcgccaucagcuucuggaugugcagcaacggcagccugcagugcagaaucugcaucuga

SEQ ID NO: 158189 - RNA, 1701 nt, Artificial Sequence
  derived and/or modified sequence opt4 from hemagglutinin__InfluenzaA__ADM26282
augaaggccauccugguggugcugcuguacaccuucaccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccacagcaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagagaagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158190 - RNA, 1701 nt, Artificial Sequence
  derived and/or modified sequence opt4 from hemagglutinin__InfluenzaA__ADM26283
augaaggccauccugguggugcugcuguacaccuucaccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccacagcaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158191 - RNA, 1701 nt, Artificial Sequence; identical to SEQ ID NO: 157218
  derived and/or modified sequence opt4 from hemagglutinin__InfluenzaA__ADM26284

SEQ ID NO: 158192 - RNA, 1701 nt, Artificial Sequence; identical to SEQ ID NO: 157218
  derived and/or modified sequence opt4 from hemagglutinin__InfluenzaA__ADM26285

SEQ ID NO: 158193 - RNA, 1701 nt, Artificial Sequence
  derived and/or modified sequence opt4 from hemagglutinin__InfluenzaA__ADM26784
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaugagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 158194 - RNA, 1701 nt, Artificial Sequence; identical to SEQ ID NO: 154954
  derived and/or modified sequence opt4 from hemagglutinin__InfluenzaA__ADM26795

SEQ ID NO: 158195 - RNA, 1701 nt, Artificial Sequence
  derived and/or modified sequence opt4 from hemagglutinin__InfluenzaA__ADM26817
augaagaccaccaucgcccugagccacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcgccggcgagaucugcgacagcccccaccagauccuggacggcgagaacugcacccugaucgacgcccugcugggcgacccccagugcgacggcuuccagaacaagaagugggaccuguucguggagagaagaagagccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 158196 - RNA, 1704 nt, Artificial Sequence
  derived and/or modified sequence opt4 from hemagglutinin__InfluenzaA__ADM31424
auggagaagaucgugcugcuguucaccaccaucagccuggugaagagcgaccacaucugcaucggcuaccacgccaacaacagcaccgagcagguggacaccaucauggagaagaacgugaccgugacccacgcccaggacauccuggagaagacccacaacggcaagcugugcgaccugaacggcgugaagccccugauccugaaggacugcagcguggccggcuggcugcugggcaacccccugugcgacgaguucaucaacgugcccgaguggagcuacaucguggagaaggccaaccccgccaacgaccugugcuaccccggcaacuucaacgacuacgaggagcugaagcaccugcugagcagaaucaaccacuucgagaagauccagaucauccccaaggacagcuggagcgaccacgaggccagccugggcgugagcgccgccugcagcuaccagggcaacagcagcuucuucagaaacgugguguggcugaucaagaaggacaacgccuaccccaccaucaagaaggacuacaacaacaccaaccaggaggaccugcuggugcuguggggcauccaccaccccaacgacgaggccgagcagaccagacuguaccagaaccccaccaccuacaucagcaucggcaccagcacccugaaccagagacuggugcccaagaucgccaccagaagcaagaucaacggccagagcggcagaaucgacuucuucuggaccauccugaagcccaacgacgccauccacuucgagagcaacggcaacuucaucgcccccgaguacgccuacaagaucgugaagaagggcgacagcaccaucaugaagagcgagguggaguacggcaacugcaacaccagaugccagacccccaucggcgccaucaacagcagcaugcccuuccacaacauccacccccugaccaucggcgagugccccaaguacgugaagagcaacaagcuggugcuggccaccggccugagaaacagcccccagagagagagaagaagaaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugaaggacaacgccaaggagcugggcaacggcugcuucgaguucuaccacaagugcaacaacgagugcauggagagcgugagaaacggcaccuacgacuacccccaguacagcgaggaggccagacugaagagagaggagaucagcggcgugaagcuggagagcaucggcaucuaccagauccugagcaucuacagcaccguggccagcagccuggugcuggccaucaugauggccggccugagccuguggaugugcagcaacggcagccugcagugcagaaucugcaucuga

SEQ ID NO: 158197 - RNA, 1701 nt, Artificial Sequence; identical to SEQ ID NO: 157790
  derived and/or modified sequence opt4 from hemagglutinin__InfluenzaA__ADM31478

SEQ ID NO: 158198 - RNA, 1701 nt, Artificial Sequence
  derived and/or modified sequence opt4 from hemagglutinin__InfluenzaA__ADM31488
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcaaguacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggaggugggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccgccgccagcagccuggugcugguggugagccugggcgccaucagcuucuggaugugcagcaacggcagccugcagugcagaaucugcaucuga

SEQ ID NO: 158199 - RNA, 1701 nt, Artificial Sequence
  derived and/or modified sequence opt4 from hemagglutinin__InfluenzaA__ADM31498
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccuggugaagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagcacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158200 - RNA, 1701 nt, Artificial Sequence
  derived and/or modified sequence opt4 from hemagglutinin__InfluenzaA__ADM31508
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagaagcuggcccaaccacgacagcaacaagggcgugaccgccgccugcccccacgccggcgccaagagcuucuacaagagccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagcacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158201 - RNA, 1701 nt, Artificial Sequence
  derived and/or modified sequence opt4 from hemagglutinin__InfluenzaA__ADM31518
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacgugaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158202 - RNA, 1701 nt, Artificial Sequence
  derived and/or modified sequence opt4 from hemagglutinin__InfluenzaA__ADM31528
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagauguuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggaggugggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158203 - RNA, 1701 nt, Artificial Sequence
  derived and/or modified sequence opt4 from hemagglutinin__InfluenzaA__ADM31538
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacgacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158204 - RNA, 1701 nt, Artificial Sequence
  derived and/or modified sequence opt4 from hemagglutinin__InfluenzaA__ADM31548
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagguggccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158205 - RNA, 1701 nt, Artificial Sequence
  derived and/or modified sequence opt4 from hemagglutinin__InfluenzaA__ADM31558
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucagaaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158206 - RNA, 1701 nt, Artificial Sequence; identical to SEQ ID NO: 156786
  derived and/or modified sequence opt4 from hemagglutinin__InfluenzaA__ADM31568

SEQ ID NO: 158207 - RNA, 1701 nt, Artificial Sequence; identical to SEQ ID NO: 155189
  derived and/or modified sequence opt4 from hemagglutinin__InfluenzaA__ADM31578

SEQ ID NO: 158208 - RNA, 1701 nt, Artificial Sequence
  derived and/or modified sequence opt4 from hemagglutinin__InfluenzaA__ADM31588
augaaggccauccugguggugcugcuguacaccuucgccaccgccaacgccgacacccugugcaucggcuaccacgccaacaacagcaccgacaccguggacaccauccuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagauguuccccaagaccagcagcuggcccaaccacgacagcaacaagggcgugaccgccgccugcccccacgccggcgccaagagcuucuacaagaaccugaucuggcuggugaagaagggcaacagcuaccccaagcugaacaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagaccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggaggugggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158209 - RNA, 1701 nt, Artificial Sequence
  derived and/or modified sequence opt4 from hemagglutinin__InfluenzaA__ADM31598
augaacgccauccugguggugcugcuguacaccuucgccaccgccaacgccgacacccugugcaucggcuaccacgccaacaacagcaccgacaccguggacacccugcuggagaagaacgugaccgugacccacagcgugaaccugcuggaggacaagcacaacggcaagcugugcaagcugagaggcguggccccccugcaccugggcaagugcgacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccgaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuaccacuggacccugguggagcccggcgacaagaucaccuucgaggccaccggcaaccugguggugcccagauacgccuucgccauggagagaaacgccggcagcggcaucaucaucagcgacgcccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaagaucaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158210 - RNA, 1701 nt, Artificial Sequence
  derived and/or modified sequence opt4 from hemagglutinin__InfluenzaA__ADM31608
augaaggccauccugguggugcugcuguacaccuucgccaccgugaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158211 - RNA, 1701 nt, Artificial Sequence; identical to SEQ ID NO: 156741
  derived and/or modified sequence opt4 from hemagglutinin__InfluenzaA__ADM31618

SEQ ID NO: 158212 - RNA, 1701 nt, Artificial Sequence; identical to SEQ ID NO: 156353
  derived and/or modified sequence opt4 from hemagglutinin__InfluenzaA__ADM31628

SEQ ID NO: 158213 - RNA, 1701 nt, Artificial Sequence; identical to SEQ ID NO: 158092
  derived and/or modified sequence opt4 from hemagglutinin__InfluenzaA__ADM31638

SEQ ID NO: 158214 - RNA, 1701 nt, Artificial Sequence; identical to SEQ ID NO: 156609
  derived and/or modified sequence opt4 from hemagglutinin__InfluenzaA__ADM31648

SEQ ID NO: 158215 - RNA, 1701 nt, Artificial Sequence; identical to SEQ ID NO: 157356
  derived and/or modified sequence opt4 from hemagglutinin__InfluenzaA__ADM31658

SEQ ID NO: 158216 - RNA, 1701 nt, Artificial Sequence; identical to SEQ ID NO: 156609
  derived and/or modified sequence opt4 from hemagglutinin__InfluenzaA__ADM31668

SEQ ID NO: 158217 - RNA, 1701 nt, Artificial Sequence; identical to SEQ ID NO: 155189
  derived and/or modified sequence opt4 from hemagglutinin__InfluenzaA__ADM31688

SEQ ID NO: 158218 - RNA, 1701 nt, Artificial Sequence
  derived and/or modified sequence opt4 from hemagglutinin__InfluenzaA__ADM31698
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccugauccugguggugagccugggcgccaucagcuucuggaugugcagcaacggcagccugcagugcagaaucugcaucuga

SEQ ID NO: 158219 - RNA, 1701 nt, Artificial Sequence; identical to SEQ ID NO: 158094
  derived and/or modified sequence opt4 from hemagglutinin__InfluenzaA__ADM31708

SEQ ID NO: 158220 - RNA, 1701 nt, Artificial Sequence
  derived and/or modified sequence opt4 from hemagglutinin__InfluenzaA__ADM31718
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158221 - RNA, 1701 nt, Artificial Sequence
  derived and/or modified sequence opt4 from hemagglutinin__InfluenzaA__ADM31728
augaaggccauccugaucgugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcggcaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaccagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158222 - RNA, 1701 nt, Artificial Sequence
  derived and/or modified sequence opt4 from hemagglutinin__InfluenzaA__ADM31738
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccagaagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158223 - RNA, 1701 nt, Artificial Sequence; identical to SEQ ID NO: 156838
  derived and/or modified sequence opt4 from hemagglutinin__InfluenzaA__ADM31748

SEQ ID NO: 158224 - RNA, 1701 nt, Artificial Sequence
  derived and/or modified sequence opt4 from hemagglutinin__InfluenzaA__ADM31758
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcaucgccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugaucgaccccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagaauggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158225 - RNA, 1701 nt, Artificial Sequence; identical to SEQ ID NO: 155549
  derived and/or modified sequence opt4 from hemagglutinin__InfluenzaA__ADM31768

SEQ ID NO: 158226 - RNA, 1701 nt, Artificial Sequence; identical to SEQ ID NO: 155189
  derived and/or modified sequence opt4 from hemagglutinin__InfluenzaA__ADM31778

SEQ ID NO: 158227 - RNA, 1701 nt, Artificial Sequence; identical to SEQ ID NO: 157356
  derived and/or modified sequence opt4 from hemagglutinin__InfluenzaA__ADM31798

SEQ ID NO: 158228 - RNA, 1701 nt, Artificial Sequence
  derived and/or modified sequence opt4 from hemagglutinin__InfluenzaA__ADM31808
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcggcaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugcuguggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccuggugggccccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158229 - RNA, 1701 nt, Artificial Sequence; identical to SEQ ID NO: 157356
  derived and/or modified sequence opt4 from hemagglutinin__InfluenzaA__ADM31818

SEQ ID NO: 158230 - RNA, 1701 nt, Artificial Sequence
  derived and/or modified sequence opt4 from hemagglutinin__InfluenzaA__ADM31828
augaaggccauccugguggugcugcuguacaccuucgccaccgccaacgccgacacccugugcaucggcuaccacgccaacaacagcaccgacaccguggacaccgugcuggagagaaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaagagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugcuggugagccugggcgccaucagcuucuggaugugcagcaacggcagccugcagugcagaaucugcaucuga

SEQ ID NO: 158231 - RNA, 1701 nt, Artificial Sequence; identical to SEQ ID NO: 158230
  derived and/or modified sequence opt4 from hemagglutinin__InfluenzaA__ADM31838

SEQ ID NO: 158232 - RNA, 1701 nt, Artificial Sequence; identical to SEQ ID NO: 155189
  derived and/or modified sequence opt4 from hemagglutinin__InfluenzaA__ADM31848

SEQ ID NO: 158233 - RNA, 1701 nt, Artificial Sequence
  derived and/or modified sequence opt4 from hemagglutinin__InfluenzaA__ADM31858
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcagccacgccggcgccaagagcuucuacaagaaccugaucuggcuggugaagaagggcaacagcuaccccaagcugaacaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcguggagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158234 - RNA, 1701 nt, Artificial Sequence
  derived and/or modified sequence opt4 from hemagglutinin__InfluenzaA__ADM31868
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagcugcugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcgugcaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucagcauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158235 - RNA, 1701 nt, Artificial Sequence
  derived and/or modified sequence opt4 from hemagglutinin__InfluenzaA__ADM31878
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaaggccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158236 - RNA, 1701 nt, Artificial Sequence; identical to SEQ ID NO: 156838
  derived and/or modified sequence opt4 from hemagglutinin__InfluenzaA__ADM31888

SEQ ID NO: 158237 - RNA, 1701 nt, Artificial Sequence; identical to SEQ ID NO: 155369
  derived and/or modified sequence opt4 from hemagglutinin__InfluenzaA__ADM31898

SEQ ID NO: 158238 - RNA, 1701 nt, Artificial Sequence
  derived and/or modified sequence opt4 from hemagglutinin__InfluenzaA__ADM31908
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgaccacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158239 - RNA, 1701 nt, Artificial Sequence; identical to SEQ ID NO: 155369
  derived and/or modified sequence opt4 from hemagglutinin__InfluenzaA__ADM31918

SEQ ID NO: 158240 - RNA, 1701 nt, Artificial Sequence; identical to SEQ ID NO: 156961
  derived and/or modified sequence opt4 from hemagglutinin__InfluenzaA__ADM31928

SEQ ID NO: 158241 - RNA, 1701 nt, Artificial Sequence; identical to SEQ ID NO: 156961
  derived and/or modified sequence opt4 from hemagglutinin__InfluenzaA__ADM31948

SEQ ID NO: 158242 - RNA, 1701 nt, Artificial Sequence; identical to SEQ ID NO: 155189
  derived and/or modified sequence opt4 from hemagglutinin__InfluenzaA__ADM31958

SEQ ID NO: 158243 - RNA, 1701 nt, Artificial Sequence; identical to SEQ ID NO: 156961
  derived and/or modified sequence opt4 from hemagglutinin__InfluenzaA__ADM31968

SEQ ID NO: 158244 - RNA, 1701 nt, Artificial Sequence; identical to SEQ ID NO: 156777
  derived and/or modified sequence opt4 from hemagglutinin__InfluenzaA__ADM31978

SEQ ID NO: 158245 - RNA, 1701 nt, Artificial Sequence; identical to SEQ ID NO: 155369
  derived and/or modified sequence opt4 from hemagglutinin__InfluenzaA__ADM31998

SEQ ID NO: 158246 - RNA, 1701 nt, Artificial Sequence; identical to SEQ ID NO: 155369
  derived and/or modified sequence opt4 from hemagglutinin__InfluenzaA__ADM32008

SEQ ID NO: 158247 - RNA, 1701 nt, Artificial Sequence
  derived and/or modified sequence opt4 from hemagglutinin__InfluenzaA__ADM32018
augaaggccauccugguggugcugcuguacaccuucgccaucgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcgacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158248 - RNA, 1701 nt, Artificial Sequence
  derived and/or modified sequence opt4 from hemagglutinin__InfluenzaA__ADM32028
augaaggccauccugguggugcugcuguacaccuucgccaccgccaacgccgacacccugugcaucggcuaccacgccaacaacagcaccgacaccguggacaccgugcuggagaagaacgugaccgugacccacagcguggaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacgugcaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158249 - RNA, 1701 nt, Artificial Sequence; identical to SEQ ID NO: 156961
  derived and/or modified sequence opt4 from hemagglutinin__InfluenzaA__ADM32038

SEQ ID NO: 158250 - RNA, 1701 nt, Artificial Sequence; identical to SEQ ID NO: 155369
  derived and/or modified sequence opt4 from hemagglutinin__InfluenzaA__ADM32048

SEQ ID NO: 158251 - RNA, 1701 nt, Artificial Sequence; identical to SEQ ID NO: 156353
  derived and/or modified sequence opt4 from hemagglutinin__InfluenzaA__ADM32058

SEQ ID NO: 158252 - RNA, 1701 nt, Artificial Sequence; identical to SEQ ID NO: 156353
  derived and/or modified sequence opt4 from hemagglutinin__InfluenzaA__ADM32068

SEQ ID NO: 158253 - RNA, 1701 nt, Artificial Sequence; identical to SEQ ID NO: 155189
  derived and/or modified sequence opt4 from hemagglutinin__InfluenzaA__ADM32078

SEQ ID NO: 158254 - RNA, 1701 nt, Artificial Sequence; identical to SEQ ID NO: 156777
  derived and/or modified sequence opt4 from hemagglutinin__InfluenzaA__ADM32088

SEQ ID NO: 158255 - RNA, 1701 nt, Artificial Sequence
  derived and/or modified sequence opt4 from hemagglutinin__InfluenzaA__ADM32098
augaaggccauccugguggugcugcuguacaccuucgccaucgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158256 - RNA, 1701 nt, Artificial Sequence; identical to SEQ ID NO: 155189
  derived and/or modified sequence opt4 from hemagglutinin__InfluenzaA__ADM32108

SEQ ID NO: 158257 - RNA, 1701 nt, Artificial Sequence; identical to SEQ ID NO: 156961
  derived and/or modified sequence opt4 from hemagglutinin__InfluenzaA__ADM32551

SEQ ID NO: 158258 - RNA, 1701 nt, Artificial Sequence; identical to SEQ ID NO: 155369
  derived and/or modified sequence opt4 from hemagglutinin__InfluenzaA__ADM32561

SEQ ID NO: 158259 - RNA, 1701 nt, Artificial Sequence; identical to SEQ ID NO: 155369
  derived and/or modified sequence opt4 from hemagglutinin__InfluenzaA__ADM32571

SEQ ID NO: 158260 - RNA, 1701 nt, Artificial Sequence; identical to SEQ ID NO: 155189
  derived and/or modified sequence opt4 from hemagglutinin__InfluenzaA__ADM32581

SEQ ID NO: 158261 - RNA, 1701 nt, Artificial Sequence; identical to SEQ ID NO: 156961
  derived and/or modified sequence opt4 from hemagglutinin__InfluenzaA__ADM32591

SEQ ID NO: 158262 - RNA, 1701 nt, Artificial Sequence; identical to SEQ ID NO: 155189
  derived and/or modified sequence opt4 from hemagglutinin__InfluenzaA__ADM32601

SEQ ID NO: 158263 - RNA, 1701 nt, Artificial Sequence; identical to SEQ ID NO: 155189
  derived and/or modified sequence opt4 from hemagglutinin__InfluenzaA__ADM32611

SEQ ID NO: 158264 - RNA, 1701 nt, Artificial Sequence; identical to SEQ ID NO: 156353
  derived and/or modified sequence opt4 from hemagglutinin__InfluenzaA__ADM32621

SEQ ID NO: 158265 - RNA, 1701 nt, Artificial Sequence
  derived and/or modified sequence opt4 from hemagglutinin__InfluenzaA__ADM32631
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugaagggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaaccuguaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcaaguacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacaacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158266 - RNA, 1701 nt, Artificial Sequence; identical to SEQ ID NO: 156353
  derived and/or modified sequence opt4 from hemagglutinin__InfluenzaA__ADM32641

SEQ ID NO: 158267 - RNA, 1701 nt, Artificial Sequence; identical to SEQ ID NO: 155189
  derived and/or modified sequence opt4 from hemagglutinin__InfluenzaA__ADM32651

SEQ ID NO: 158268 - RNA, 1701 nt, Artificial Sequence
  derived and/or modified sequence opt4 from hemagglutinin__InfluenzaA__ADM32661
augaaggccauccugguggugcugcuguacaccuucgccaucgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaacgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158269 - RNA, 1701 nt, Artificial Sequence; identical to SEQ ID NO: 156777
  derived and/or modified sequence opt4 from hemagglutinin__InfluenzaA__ADM32671

SEQ ID NO: 158270 - RNA, 1701 nt, Artificial Sequence; identical to SEQ ID NO: 155189
  derived and/or modified sequence opt4 from hemagglutinin__InfluenzaA__ADM32681

SEQ ID NO: 158271 - RNA, 1701 nt, Artificial Sequence; identical to SEQ ID NO: 155369
  derived and/or modified sequence opt4 from hemagglutinin__InfluenzaA__ADM32691

SEQ ID NO: 158272 - RNA, 1701 nt, Artificial Sequence; identical to SEQ ID NO: 155189
  derived and/or modified sequence opt4 from hemagglutinin__InfluenzaA__ADM32701

SEQ ID NO: 158273 - RNA, 1701 nt, Artificial Sequence; identical to SEQ ID NO: 155369
  derived and/or modified sequence opt4 from hemagglutinin__InfluenzaA__ADM32711

SEQ ID NO: 158274 - RNA, 1701 nt, Artificial Sequence; identical to SEQ ID NO: 155369
  derived and/or modified sequence opt4 from hemagglutinin__InfluenzaA__ADM32721

SEQ ID NO: 158275 - RNA, 1701 nt, Artificial Sequence; identical to SEQ ID NO: 155369
  derived and/or modified sequence opt4 from hemagglutinin__InfluenzaA__ADM32741

SEQ ID NO: 158276 - RNA, 1701 nt, Artificial Sequence; identical to SEQ ID NO: 155369
  derived and/or modified sequence opt4 from hemagglutinin__InfluenzaA__ADM32751

SEQ ID NO: 158277 - RNA, 1701 nt, Artificial Sequence; identical to SEQ ID NO: 156777
  derived and/or modified sequence opt4 from hemagglutinin__InfluenzaA__ADM32761

SEQ ID NO: 158278 - RNA, 1701 nt, Artificial Sequence
  derived and/or modified sequence opt4 from hemagglutinin__InfluenzaA__ADM32771
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcgagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcaagggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158279 - RNA, 1701 nt, Artificial Sequence
  derived and/or modified sequence opt4 from hemagglutinin__InfluenzaA__ADM32781
augaaggccauccugguggugcugcuguacaccuucgccaccgccaacgccgacacccugugcaucggcuaccacgccaacaacagcaccgacaccguggacaccgugcuggagaagaacgugaccgugacccacagcguggaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagcuuccccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158280 - RNA, 1701 nt, Artificial Sequence; identical to SEQ ID NO: 155369
  derived and/or modified sequence opt4 from hemagglutinin__InfluenzaA__ADM32791

SEQ ID NO: 158281 - RNA, 1701 nt, Artificial Sequence
  derived and/or modified sequence opt4 from hemagglutinin__InfluenzaA__ADM32801
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggagaacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158282 - RNA, 1701 nt, Artificial Sequence
  derived and/or modified sequence opt4 from hemagglutinin__InfluenzaA__ADM32811
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccacaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158283 - RNA, 1701 nt, Artificial Sequence; identical to SEQ ID NO: 155189
  derived and/or modified sequence opt4 from hemagglutinin__InfluenzaA__ADM32821

SEQ ID NO: 158284 - RNA, 1701 nt, Artificial Sequence; identical to SEQ ID NO: 156777
  derived and/or modified sequence opt4 from hemagglutinin__InfluenzaA__ADM32831

SEQ ID NO: 158285 - RNA, 1701 nt, Artificial Sequence; identical to SEQ ID NO: 155369
  derived and/or modified sequence opt4 from hemagglutinin__InfluenzaA__ADM32841

SEQ ID NO: 158286 - RNA, 1701 nt, Artificial Sequence; identical to SEQ ID NO: 156777
  derived and/or modified sequence opt4 from hemagglutinin__InfluenzaA__ADM32851

SEQ ID NO: 158287 - RNA, 1701 nt, Artificial Sequence; identical to SEQ ID NO: 155369
  derived and/or modified sequence opt4 from hemagglutinin__InfluenzaA__ADM32861

SEQ ID NO: 158288 - RNA, 1701 nt, Artificial Sequence; identical to SEQ ID NO: 156353
  derived and/or modified sequence opt4 from hemagglutinin__InfluenzaA__ADM32871

SEQ ID NO: 158289 - RNA, 1701 nt, Artificial Sequence; identical to SEQ ID NO: 157356
  derived and/or modified sequence opt4 from hemagglutinin__InfluenzaA__ADM32881

SEQ ID NO: 158290 - RNA, 1701 nt, Artificial Sequence
  derived and/or modified sequence opt4 from hemagglutinin__InfluenzaA__ADM32929
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugagaugcagaaucugcaucuga

SEQ ID NO: 158291 - RNA, 1701 nt, Artificial Sequence
  derived and/or modified sequence opt4 from hemagglutinin__InfluenzaA__ADM32939
auggaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccacaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugagaugcagaaucugcaucuga

SEQ ID NO: 158292 - RNA, 1701 nt, Artificial Sequence
  derived and/or modified sequence opt4 from hemagglutinin__InfluenzaA__ADM32949
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaacggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugagaugcagaaucugcaucuga

SEQ ID NO: 158293 - RNA, 1701 nt, Artificial Sequence
  derived and/or modified sequence opt4 from hemagglutinin__InfluenzaA__ADM32958
augaaggccauccugguguuccugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucguggagagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagacuggagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggaggugggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccgccgccagcagccuggugcugguggugagccugggcgccaucagcuucuggaugugcagcaacggcagccugagaugcagaaucugcaucuga

SEQ ID NO: 158294 - RNA, 1701 nt, Artificial Sequence
  derived and/or modified sequence opt4 from hemagglutinin__InfluenzaA__ADM32977
augaaggccauccugguggugcugcugugcaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcaaguacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacggcaucaccaacaagaucaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugagaugcagaaucugcaucuga

SEQ ID NO: 158295 - RNA, 1701 nt, Artificial Sequence
  derived and/or modified sequence opt4 from hemagglutinin__InfluenzaA__ADM32986
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccaacagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcaaguacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacggcaucaccaacaagaucaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccugaacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugagaugcagaaucugcaucuga

SEQ ID NO: 158296 - RNA, 1701 nt, Artificial Sequence
  derived and/or modified sequence opt4 from hemagglutinin__InfluenzaA__ADM32995
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccaacagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcaaguacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacggcaucaccaacaagaucaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugagaugcagaaucugcaucuga

SEQ ID NO: 158297 - RNA, 1701 nt, Artificial Sequence; identical to SEQ ID NO: 156290
  derived and/or modified sequence opt4 from hemagglutinin__InfluenzaA__ADM33004

SEQ ID NO: 158298 - RNA, 1701 nt, Artificial Sequence; identical to SEQ ID NO: 155189
  derived and/or modified sequence opt4 from hemagglutinin__InfluenzaA__ADM33023

SEQ ID NO: 158299 - RNA, 1701 nt, Artificial Sequence
  derived and/or modified sequence opt4 from hemagglutinin__InfluenzaA__ADM33040
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugagaugcagaaucugcaucuga

SEQ ID NO: 158300 - RNA, 1701 nt, Artificial Sequence
  derived and/or modified sequence opt4 from hemagglutinin__InfluenzaA__ADM33050
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugaacaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugcuggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugagaugcagaaucugcaucuga

SEQ ID NO: 158301 - RNA, 1701 nt, Artificial Sequence
  derived and/or modified sequence opt4 from hemagglutinin__InfluenzaA__ADM33069
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugagaugcagaaucugcaucuga

SEQ ID NO: 158302 - RNA, 1701 nt, Artificial Sequence
  derived and/or modified sequence opt4 from hemagglutinin__InfluenzaA__ADM33079
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugagaugcagaaucugcaucuga

SEQ ID NO: 158303 - RNA, 1701 nt, Artificial Sequence
  derived and/or modified sequence opt4 from hemagglutinin__InfluenzaA__ADM33099
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugauggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugagaugcagaaucugcaucuga

SEQ ID NO: 158304 - RNA, 1701 nt, Artificial Sequence; identical to SEQ ID NO: 158303
  derived and/or modified sequence opt4 from hemagglutinin__InfluenzaA__ADM33109

SEQ ID NO: 158305 - RNA, 1701 nt, Artificial Sequence
  derived and/or modified sequence opt4 from hemagglutinin__InfluenzaA__ADM33128
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugagaugcagaaucugcaucuga

SEQ ID NO: 158306 - RNA, 1701 nt, Artificial Sequence; identical to SEQ ID NO: 158305
  derived and/or modified sequence opt4 from hemagglutinin__InfluenzaA__ADM33137

SEQ ID NO: 158307 - RNA, 1701 nt, Artificial Sequence; identical to SEQ ID NO: 158305
  derived and/or modified sequence opt4 from hemagglutinin__InfluenzaA__ADM33147

SEQ ID NO: 158308 - RNA, 1701 nt, Artificial Sequence; identical to SEQ ID NO: 158305
  derived and/or modified sequence opt4 from hemagglutinin__InfluenzaA__ADM33157

SEQ ID NO: 158309 - RNA, 1701 nt, Artificial Sequence
  derived and/or modified sequence opt4 from hemagglutinin__InfluenzaA__ADM33167
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugagaugcagaaucugcaucuga

SEQ ID NO: 158310 - RNA, 1701 nt, Artificial Sequence; identical to SEQ ID NO: 157376
  derived and/or modified sequence opt4 from hemagglutinin__InfluenzaA__ADM33177

SEQ ID NO: 158311 - RNA, 1701 nt, Artificial Sequence; identical to SEQ ID NO: 158305
  derived and/or modified sequence opt4 from hemagglutinin__InfluenzaA__ADM33186

SEQ ID NO: 158312 - RNA, 1701 nt, Artificial Sequence; identical to SEQ ID NO: 158305
  derived and/or modified sequence opt4 from hemagglutinin__InfluenzaA__ADM33195

SEQ ID NO: 158313 - RNA, 1701 nt, Artificial Sequence; identical to SEQ ID NO: 158302
  derived and/or modified sequence opt4 from hemagglutinin__InfluenzaA__ADM33204

SEQ ID NO: 158314 - RNA, 1701 nt, Artificial Sequence
  derived and/or modified sequence opt4 from hemagglutinin__InfluenzaA__ADM33222
auggaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccacaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugagaugcagaaucugcaucuga

SEQ ID NO: 158315 - RNA, 1701 nt, Artificial Sequence
  derived and/or modified sequence opt4 from hemagglutinin__InfluenzaA__ADM33232
auggaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccacaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaccaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158316 - RNA, 1701 nt, Artificial Sequence
  derived and/or modified sequence opt4 from hemagglutinin__InfluenzaA__ADM33241
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaaggagaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucaccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugagaugcagaaucugcaucuga

SEQ ID NO: 158317 - RNA, 1701 nt, Artificial Sequence; identical to SEQ ID NO: 158314
  derived and/or modified sequence opt4 from hemagglutinin__InfluenzaA__ADM33251

SEQ ID NO: 158318 - RNA, 1701 nt, Artificial Sequence
  derived and/or modified sequence opt4 from hemagglutinin__InfluenzaA__ADM33260
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcgacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacaccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugagaugcagaaucugcaucuga

SEQ ID NO: 158319 - RNA, 1701 nt, Artificial Sequence
  derived and/or modified sequence opt4 from hemagglutinin__InfluenzaA__ADM33280
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgugagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccagaggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158320 - RNA, 1701 nt, Artificial Sequence; identical to SEQ ID NO: 155636
  derived and/or modified sequence opt4 from hemagglutinin__InfluenzaA__ADM33290

SEQ ID NO: 158321 - RNA, 1701 nt, Artificial Sequence; identical to SEQ ID NO: 155189
  derived and/or modified sequence opt4 from hemagglutinin__InfluenzaA__ADM33300

SEQ ID NO: 158322 - RNA, 1701 nt, Artificial Sequence; identical to SEQ ID NO: 155176
  derived and/or modified sequence opt4 from hemagglutinin__InfluenzaA__ADM33310

SEQ ID NO: 158323 - RNA, 1701 nt, Artificial Sequence
  derived and/or modified sequence opt4 from hemagglutinin__InfluenzaA__ADM33320
augaaggccauccugguggugaugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccuucagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158324 - RNA, 1701 nt, Artificial Sequence; identical to SEQ ID NO: 155215
  derived and/or modified sequence opt4 from hemagglutinin__InfluenzaA__ADM33340

SEQ ID NO: 158325 - RNA, 1701 nt, Artificial Sequence
  derived and/or modified sequence opt4 from hemagglutinin__InfluenzaA__ADM33355
augaaggccauccugguggugaugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacaacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158326 - RNA, 1701 nt, Artificial Sequence; identical to SEQ ID NO: 158325
  derived and/or modified sequence opt4 from hemagglutinin__InfluenzaA__ADM33365

SEQ ID NO: 158327 - RNA, 1701 nt, Artificial Sequence; identical to SEQ ID NO: 155215
  derived and/or modified sequence opt4 from hemagglutinin__InfluenzaA__ADM33375

SEQ ID NO: 158328 - RNA, 1701 nt, Artificial Sequence
  derived and/or modified sequence opt4 from hemagglutinin__InfluenzaA__ADM33385
augaaggccauccugguggugaugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagaccagcaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158329 - RNA, 1701 nt, Artificial Sequence; identical to SEQ ID NO: 155636
  derived and/or modified sequence opt4 from hemagglutinin__InfluenzaA__ADM33395

SEQ ID NO: 158330 - RNA, 1701 nt, Artificial Sequence; identical to SEQ ID NO: 155636
  derived and/or modified sequence opt4 from hemagglutinin__InfluenzaA__ADM33405

SEQ ID NO: 158331 - RNA, 1701 nt, Artificial Sequence; identical to SEQ ID NO: 158325
  derived and/or modified sequence opt4 from hemagglutinin__InfluenzaA__ADM33415

SEQ ID NO: 158332 - RNA, 1701 nt, Artificial Sequence; identical to SEQ ID NO: 156032
  derived and/or modified sequence opt4 from hemagglutinin__InfluenzaA__ADM33425

SEQ ID NO: 158333 - RNA, 1701 nt, Artificial Sequence
  derived and/or modified sequence opt4 from hemagglutinin__InfluenzaA__ADM34007
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccuggaggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158334 - RNA, 1701 nt, Artificial Sequence; identical to SEQ ID NO: 155189
  derived and/or modified sequence opt4 from hemagglutinin__InfluenzaA__ADM52443

SEQ ID NO: 158335 - RNA, 1701 nt, Artificial Sequence
  derived and/or modified sequence opt4 from hemagglutinin__InfluenzaA__ADM52453
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccauccacgacugcaacaccaccugccagacccccaagggcgccaucaacaccagccugcccuuccagaacgugcaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158336 - RNA, 1701 nt, Artificial Sequence
  derived and/or modified sequence opt4 from hemagglutinin__InfluenzaA__ADM52473
augaaggccauccuggccgugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcggcaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugcuguggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccuggugggccccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158337 - RNA, 1701 nt, Artificial Sequence; identical to SEQ ID NO: 156353
  derived and/or modified sequence opt4 from hemagglutinin__InfluenzaA__ADM52483

SEQ ID NO: 158338 - RNA, 1701 nt, Artificial Sequence; identical to SEQ ID NO: 155369
  derived and/or modified sequence opt4 from hemagglutinin__InfluenzaA__ADM52493

SEQ ID NO: 158339 - RNA, 1701 nt, Artificial Sequence; identical to SEQ ID NO: 155369
  derived and/or modified sequence opt4 from hemagglutinin__InfluenzaA__ADM52513

SEQ ID NO: 158340 - RNA, 1701 nt, Artificial Sequence; identical to SEQ ID NO: 155369
  derived and/or modified sequence opt4 from hemagglutinin__InfluenzaA__ADM52524

SEQ ID NO: 158341 - RNA, 1701 nt, Artificial Sequence; identical to SEQ ID NO: 155369
  derived and/or modified sequence opt4 from hemagglutinin__InfluenzaA__ADM52534

SEQ ID NO: 158342 - RNA, 1701 nt, Artificial Sequence; identical to SEQ ID NO: 155369
  derived and/or modified sequence opt4 from hemagglutinin__InfluenzaA__ADM52554

SEQ ID NO: 158343 - RNA, 1701 nt, Artificial Sequence; identical to SEQ ID NO: 155369
  derived and/or modified sequence opt4 from hemagglutinin__InfluenzaA__ADM52564

SEQ ID NO: 158344 - RNA, 1701 nt, Artificial Sequence; identical to SEQ ID NO: 155176
  derived and/or modified sequence opt4 from hemagglutinin__InfluenzaA__ADM52574

SEQ ID NO: 158345 - RNA, 1701 nt, Artificial Sequence; identical to SEQ ID NO: 155189
  derived and/or modified sequence opt4 from hemagglutinin__InfluenzaA__ADM52584

SEQ ID NO: 158346 - RNA, 1701 nt, Artificial Sequence
  derived and/or modified sequence opt4 from hemagglutinin__InfluenzaA__ADM52594
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcaaguacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158347 - RNA, 1701 nt, Artificial Sequence; identical to SEQ ID NO: 155369
  derived and/or modified sequence opt4 from hemagglutinin__InfluenzaA__ADM52604

SEQ ID NO: 158348 - RNA, 1701 nt, Artificial Sequence; identical to SEQ ID NO: 155369
  derived and/or modified sequence opt4 from hemagglutinin__InfluenzaA__ADM52614

SEQ ID NO: 158349 - RNA, 1701 nt, Artificial Sequence; identical to SEQ ID NO: 156961
  derived and/or modified sequence opt4 from hemagglutinin__InfluenzaA__ADM52624

SEQ ID NO: 158350 - RNA, 1701 nt, Artificial Sequence; identical to SEQ ID NO: 155369
  derived and/or modified sequence opt4 from hemagglutinin__InfluenzaA__ADM52634

SEQ ID NO: 158351 - RNA, 1701 nt, Artificial Sequence; identical to SEQ ID NO: 155369
  derived and/or modified sequence opt4 from hemagglutinin__InfluenzaA__ADM52644

SEQ ID NO: 158352 - RNA, 1701 nt, Artificial Sequence; identical to SEQ ID NO: 155369
  derived and/or modified sequence opt4 from hemagglutinin__InfluenzaA__ADM52654

SEQ ID NO: 158353 - RNA, 1701 nt, Artificial Sequence; identical to SEQ ID NO: 156777
  derived and/or modified sequence opt4 from hemagglutinin__InfluenzaA__ADM52664

SEQ ID NO: 158354 - RNA, 1701 nt, Artificial Sequence; identical to SEQ ID NO: 156961
  derived and/or modified sequence opt4 from hemagglutinin__InfluenzaA__ADM52674

SEQ ID NO: 158355 - RNA, 1701 nt, Artificial Sequence; identical to SEQ ID NO: 155369
  derived and/or modified sequence opt4 from hemagglutinin__InfluenzaA__ADM52684

SEQ ID NO: 158356 - RNA, 1701 nt, Artificial Sequence; identical to SEQ ID NO: 156961
  derived and/or modified sequence opt4 from hemagglutinin__InfluenzaA__ADM52704

SEQ ID NO: 158357 - RNA, 1701 nt, Artificial Sequence; identical to SEQ ID NO: 156777
  derived and/or modified sequence opt4 from hemagglutinin__InfluenzaA__ADM52714

SEQ ID NO: 158358 - RNA, 1701 nt, Artificial Sequence
  derived and/or modified sequence opt4 from hemagglutinin__InfluenzaA__ADM86399
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccgugaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggaggugggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccgccgccagcagccuggugcugguggugagccugggcgccaucagcuucuggaugugcagcaacggcagccugcagugcagaaucugcaucuga

SEQ ID NO: 158359 - RNA, 1701 nt, Artificial Sequence; identical to SEQ ID NO: 155189
  derived and/or modified sequence opt4 from hemagglutinin__InfluenzaA__ADM86409

SEQ ID NO: 158360 - RNA, 1701 nt, Artificial Sequence; identical to SEQ ID NO: 155189
  derived and/or modified sequence opt4 from hemagglutinin__InfluenzaA__ADM86419

SEQ ID NO: 158361 - RNA, 1701 nt, Artificial Sequence; identical to SEQ ID NO: 156838
  derived and/or modified sequence opt4 from hemagglutinin__InfluenzaA__ADM86440

SEQ ID NO: 158362 - RNA, 1701 nt, Artificial Sequence; identical to SEQ ID NO: 155189
  derived and/or modified sequence opt4 from hemagglutinin__InfluenzaA__ADM86450

SEQ ID NO: 158363 - RNA, 1707 nt, Artificial Sequence
  derived and/or modified sequence opt4 from hemagglutinin__InfluenzaA__ADM95450
auggagaagaucgugcugcuguucgccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgugaacgaccugugcuaccccggcgacuucaacgacuacgaggagcugaagcaccugcugagcagaaucaaccacuucgagaagauccagaucauccccaagagcagcuggcccagccacgaggccagccugggcgugagcgccgccugccccuaccagggcaagagcagcuucuucagaaacgugguguggcugaucaagaagaacaacaccuaccccaccaucaagagaagcuacaacaacaccaaccaggaggaccugcuggugauguggggcauccaccaccccaacgacgccgccgagcagaccaaccuguaccagaaccccaccaccuacaucagcgugggcaccagcacccugaaccagagacugacccccagaaucgccaccagaagcaaggugaacggccagagcggcagaauggaguucuucuggaccauccugaagcccaacgacgccaucaacuucgagagcaacggcaacuucaucgcccccgaguacgccuacaagaucgugaagaagggcgacagcaccaucaugaagagcgagcuggaguacggcaacugcaacaccaagugccagacccccaugggcgccaucaacagcagcaugcccuuccacaacauccacccccugaccaucggcgagugccccaaguacgugaagagcaacagacuggugcuggccaccggccugagaaacagcccccagagagagggcagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaucuaccagauccugagcaucuacagcaccguggccagcagccuggcccuggccaucaugguggccggccugagccuguggaugugcagcaacggcagccugcagugcagaaucugcaucuga

SEQ ID NO: 158364 - RNA, 1701 nt, Artificial Sequence; identical to SEQ ID NO: 155189
  derived and/or modified sequence opt4 from hemagglutinin__InfluenzaA__ADM95745

SEQ ID NO: 158365 - RNA, 1701 nt, Artificial Sequence; identical to SEQ ID NO: 155189
  derived and/or modified sequence opt4 from hemagglutinin__InfluenzaA__ADM95746

SEQ ID NO: 158366 - RNA, 1701 nt, Artificial Sequence; identical to SEQ ID NO: 155189
  derived and/or modified sequence opt4 from hemagglutinin__InfluenzaA__ADM95747

SEQ ID NO: 158367 - RNA, 1701 nt, Artificial Sequence; identical to SEQ ID NO: 155189
  derived and/or modified sequence opt4 from hemagglutinin__InfluenzaA__ADM95749

SEQ ID NO: 158368 - RNA, 1701 nt, Artificial Sequence
  derived and/or modified sequence opt4 from hemagglutinin__InfluenzaA__ADM95750
augaaggccauccugguggugcugcuguacaccuucgccaccgccaacgccgacacccugugcaucggcuaccacgccaacaacagcaccgacaccguggacaccgugcuggagaagaacgugaccgugacccacagcuucaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcagcagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158369 - RNA, 1701 nt, Artificial Sequence; identical to SEQ ID NO: 155189
  derived and/or modified sequence opt4 from hemagglutinin__InfluenzaA__ADM95751

SEQ ID NO: 158370 - RNA, 1701 nt, Artificial Sequence; identical to SEQ ID NO: 155189
  derived and/or modified sequence opt4 from hemagglutinin__InfluenzaA__ADM95752

SEQ ID NO: 158371 - RNA, 1701 nt, Artificial Sequence; identical to SEQ ID NO: 155189
  derived and/or modified sequence opt4 from hemagglutinin__InfluenzaA__ADM95753

SEQ ID NO: 158372 - RNA, 1701 nt, Artificial Sequence; identical to SEQ ID NO: 155189
  derived and/or modified sequence opt4 from hemagglutinin__InfluenzaA__ADM95754

SEQ ID NO: 158373 - RNA, 1701 nt, Artificial Sequence; identical to SEQ ID NO: 155189
  derived and/or modified sequence opt4 from hemagglutinin__InfluenzaA__ADM95755

SEQ ID NO: 158374 - RNA, 1701 nt, Artificial Sequence; identical to SEQ ID NO: 155369
  derived and/or modified sequence opt4 from hemagglutinin__InfluenzaA__ADM95757

SEQ ID NO: 158375 - RNA, 1701 nt, Artificial Sequence; identical to SEQ ID NO: 155189
  derived and/or modified sequence opt4 from hemagglutinin__InfluenzaA__ADM95758

SEQ ID NO: 158376 - RNA, 1701 nt, Artificial Sequence
  derived and/or modified sequence opt4 from hemagglutinin__InfluenzaA__ADM95759
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacuacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158377 - RNA, 1701 nt, Artificial Sequence; identical to SEQ ID NO: 155176
  derived and/or modified sequence opt4 from hemagglutinin__InfluenzaA__ADM95760

SEQ ID NO: 158378 - RNA, 1701 nt, Artificial Sequence; identical to SEQ ID NO: 155189
  derived and/or modified sequence opt4 from hemagglutinin__InfluenzaA__ADM95761

SEQ ID NO: 158379 - RNA, 1701 nt, Artificial Sequence
  derived and/or modified sequence opt4 from hemagglutinin__InfluenzaA__ADM95763
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagaacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158380 - RNA, 1701 nt, Artificial Sequence; identical to SEQ ID NO: 155189
  derived and/or modified sequence opt4 from hemagglutinin__InfluenzaA__ADM95764

SEQ ID NO: 158381 - RNA, 1701 nt, Artificial Sequence; identical to SEQ ID NO: 155189
  derived and/or modified sequence opt4 from hemagglutinin__InfluenzaA__ADM95765

SEQ ID NO: 158382 - RNA, 1701 nt, Artificial Sequence; identical to SEQ ID NO: 155189
  derived and/or modified sequence opt4 from hemagglutinin__InfluenzaA__ADM95767

SEQ ID NO: 158383 - RNA, 1701 nt, Artificial Sequence; identical to SEQ ID NO: 156032
  derived and/or modified sequence opt4 from hemagglutinin__InfluenzaA__ADM95768

SEQ ID NO: 158384 - RNA, 1701 nt, Artificial Sequence; identical to SEQ ID NO: 155542
  derived and/or modified sequence opt4 from hemagglutinin__InfluenzaA__ADM95769

SEQ ID NO: 158385 - RNA, 1701 nt, Artificial Sequence; identical to SEQ ID NO: 157305
  derived and/or modified sequence opt4 from hemagglutinin__InfluenzaA__ADM95771

SEQ ID NO: 158386 - RNA, 1701 nt, Artificial Sequence; identical to SEQ ID NO: 155189
  derived and/or modified sequence opt4 from hemagglutinin__InfluenzaA__ADM95772

SEQ ID NO: 158387 - RNA, 1701 nt, Artificial Sequence; identical to SEQ ID NO: 155189
  derived and/or modified sequence opt4 from hemagglutinin__InfluenzaA__ADM95774

SEQ ID NO: 158388 - RNA, 1701 nt, Artificial Sequence; identical to SEQ ID NO: 155189
  derived and/or modified sequence opt4 from hemagglutinin__InfluenzaA__ADM95775

SEQ ID NO: 158389 - RNA, 1701 nt, Artificial Sequence; identical to SEQ ID NO: 155542
  derived and/or modified sequence opt4 from hemagglutinin__InfluenzaA__ADM95776

SEQ ID NO: 158390 - RNA, 1701 nt, Artificial Sequence; identical to SEQ ID NO: 155542
  derived and/or modified sequence opt4 from hemagglutinin__InfluenzaA__ADM95778

SEQ ID NO: 158391 - RNA, 1701 nt, Artificial Sequence
  derived and/or modified sequence opt4 from hemagglutinin__InfluenzaA__ADM95779
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagcccaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158392 - RNA, 1701 nt, Artificial Sequence; identical to SEQ ID NO: 155542
  derived and/or modified sequence opt4 from hemagglutinin__InfluenzaA__ADM95780

SEQ ID NO: 158393 - RNA, 1701 nt, Artificial Sequence; identical to SEQ ID NO: 156032
  derived and/or modified sequence opt4 from hemagglutinin__InfluenzaA__ADM95783

SEQ ID NO: 158394 - RNA, 1701 nt, Artificial Sequence; identical to SEQ ID NO: 155189
  derived and/or modified sequence opt4 from hemagglutinin__InfluenzaA__ADM95784

SEQ ID NO: 158395 - RNA, 1701 nt, Artificial Sequence; identical to SEQ ID NO: 155189
  derived and/or modified sequence opt4 from hemagglutinin__InfluenzaA__ADM95785

SEQ ID NO: 158396 - RNA, 1701 nt, Artificial Sequence
  derived and/or modified sequence opt4 from hemagglutinin__InfluenzaA__ADM95786
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcagccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158397 - RNA, 1701 nt, Artificial Sequence; identical to SEQ ID NO: 155542
  derived and/or modified sequence opt4 from hemagglutinin__InfluenzaA__ADM95788

SEQ ID NO: 158398 - RNA, 1701 nt, Artificial Sequence; identical to SEQ ID NO: 155542
  derived and/or modified sequence opt4 from hemagglutinin__InfluenzaA__ADM95789

SEQ ID NO: 158399 - RNA, 1701 nt, Artificial Sequence
  derived and/or modified sequence opt4 from hemagglutinin__InfluenzaA__ADM95790
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagaaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158400 - RNA, 1701 nt, Artificial Sequence; identical to SEQ ID NO: 158399
  derived and/or modified sequence opt4 from hemagglutinin__InfluenzaA__ADM95791

SEQ ID NO: 158401 - RNA, 1701 nt, Artificial Sequence; identical to SEQ ID NO: 158399
  derived and/or modified sequence opt4 from hemagglutinin__InfluenzaA__ADM95792

SEQ ID NO: 158402 - RNA, 1701 nt, Artificial Sequence; identical to SEQ ID NO: 157786
  derived and/or modified sequence opt4 from hemagglutinin__InfluenzaA__ADM95793

SEQ ID NO: 158403 - RNA, 1701 nt, Artificial Sequence; identical to SEQ ID NO: 155542
  derived and/or modified sequence opt4 from hemagglutinin__InfluenzaA__ADM95794

SEQ ID NO: 158404 - RNA, 1701 nt, Artificial Sequence; identical to SEQ ID NO: 155189
  derived and/or modified sequence opt4 from hemagglutinin__InfluenzaA__ADM95795

SEQ ID NO: 158405 - RNA, 1701 nt, Artificial Sequence; identical to SEQ ID NO: 156291
  derived and/or modified sequence opt4 from hemagglutinin__InfluenzaA__ADM95798

SEQ ID NO: 158406 - RNA, 1701 nt, Artificial Sequence
  derived and/or modified sequence opt4 from hemagglutinin__InfluenzaA__ADM95799
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucgagaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158407 - RNA, 1701 nt, Artificial Sequence
  derived and/or modified sequence opt4 from hemagglutinin__InfluenzaA__ADM95800
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggcccccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158408 - RNA, 1701 nt, Artificial Sequence; identical to SEQ ID NO: 155542
  derived and/or modified sequence opt4 from hemagglutinin__InfluenzaA__ADM95801

SEQ ID NO: 158409 - RNA, 1701 nt, Artificial Sequence; identical to SEQ ID NO: 155542
  derived and/or modified sequence opt4 from hemagglutinin__InfluenzaA__ADM95802

SEQ ID NO: 158410 - RNA, 1701 nt, Artificial Sequence; identical to SEQ ID NO: 158396
  derived and/or modified sequence opt4 from hemagglutinin__InfluenzaA__ADM95803

SEQ ID NO: 158411 - RNA, 1701 nt, Artificial Sequence
  derived and/or modified sequence opt4 from hemagglutinin__InfluenzaA__ADM95804
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagaacuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaagcuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158412 - RNA, 1701 nt, Artificial Sequence; identical to SEQ ID NO: 156871
  derived and/or modified sequence opt4 from hemagglutinin__InfluenzaA__ADM95805

SEQ ID NO: 158413 - RNA, 1701 nt, Artificial Sequence; identical to SEQ ID NO: 156290
  derived and/or modified sequence opt4 from hemagglutinin__InfluenzaA__ADM95808

SEQ ID NO: 158414 - RNA, 1701 nt, Artificial Sequence; identical to SEQ ID NO: 156290
  derived and/or modified sequence opt4 from hemagglutinin__InfluenzaA__ADM95809

SEQ ID NO: 158415 - RNA, 1701 nt, Artificial Sequence; identical to SEQ ID NO: 156290
  derived and/or modified sequence opt4 from hemagglutinin__InfluenzaA__ADM95810

SEQ ID NO: 158416 - RNA, 1701 nt, Artificial Sequence
  derived and/or modified sequence opt4 from hemagglutinin__InfluenzaA__ADM95812
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagcugcugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158417 - RNA, 1701 nt, Artificial Sequence; identical to SEQ ID NO: 157786
  derived and/or modified sequence opt4 from hemagglutinin__InfluenzaA__ADM95816

SEQ ID NO: 158418 - RNA, 1701 nt, Artificial Sequence; identical to SEQ ID NO: 157786
  derived and/or modified sequence opt4 from hemagglutinin__InfluenzaA__ADM95819

SEQ ID NO: 158419 - RNA, 1701 nt, Artificial Sequence; identical to SEQ ID NO: 156871
  derived and/or modified sequence opt4 from hemagglutinin__InfluenzaA__ADM95820

SEQ ID NO: 158420 - RNA, 1701 nt, Artificial Sequence; identical to SEQ ID NO: 157786
  derived and/or modified sequence opt4 from hemagglutinin__InfluenzaA__ADM95821

SEQ ID NO: 158421 - RNA, 1701 nt, Artificial Sequence; identical to SEQ ID NO: 156290
  derived and/or modified sequence opt4 from hemagglutinin__InfluenzaA__ADM95822

SEQ ID NO: 158422 - RNA, 1701 nt, Artificial Sequence; identical to SEQ ID NO: 156290
  derived and/or modified sequence opt4 from hemagglutinin__InfluenzaA__ADM95823

SEQ ID NO: 158423 - RNA, 1701 nt, Artificial Sequence
  derived and/or modified sequence opt4 from hemagglutinin__InfluenzaA__ADM95824
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuaccacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagaauggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158424 - RNA, 1701 nt, Artificial Sequence; identical to SEQ ID NO: 157786
  derived and/or modified sequence opt4 from hemagglutinin__InfluenzaA__ADM95825

SEQ ID NO: 158425 - RNA, 1701 nt, Artificial Sequence; identical to SEQ ID NO: 157786
  derived and/or modified sequence opt4 from hemagglutinin__InfluenzaA__ADM95826

SEQ ID NO: 158426 - RNA, 1701 nt, Artificial Sequence
  derived and/or modified sequence opt4 from hemagglutinin__InfluenzaA__ADM95827
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugaagggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagcacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158427 - RNA, 1701 nt, Artificial Sequence
  derived and/or modified sequence opt4 from hemagglutinin__InfluenzaA__ADM95828
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgcccacgacugcaacaccaccugccagacccccaagggcgccaucaacaccagccugcccuuccagaacauccaccccaucaccaucggcaagugccccaaguacgugaagagcaccaagcugagaauggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158428 - RNA, 1701 nt, Artificial Sequence
  derived and/or modified sequence opt4 from hemagglutinin__InfluenzaA__ADM95829
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaagcuguacgagaaggugagaagccagcugaagaacaacgccaaggagaucggcaacggcugcuucgaguucuaccacaagugcgacaacaugugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158429 - RNA, 1701 nt, Artificial Sequence
  derived and/or modified sequence opt4 from hemagglutinin__InfluenzaA__ADM95831
augaaggccauccugguggugcugcuguacaccuucgugaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagaagaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagcacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158430 - RNA, 1701 nt, Artificial Sequence; identical to SEQ ID NO: 156290
  derived and/or modified sequence opt4 from hemagglutinin__InfluenzaA__ADM95832

SEQ ID NO: 158431 - RNA, 1701 nt, Artificial Sequence; identical to SEQ ID NO: 156871
  derived and/or modified sequence opt4 from hemagglutinin__InfluenzaA__ADM95833

SEQ ID NO: 158432 - RNA, 1701 nt, Artificial Sequence; identical to SEQ ID NO: 158416
  derived and/or modified sequence opt4 from hemagglutinin__InfluenzaA__ADM95834

SEQ ID NO: 158433 - RNA, 1701 nt, Artificial Sequence; identical to SEQ ID NO: 156871
  derived and/or modified sequence opt4 from hemagglutinin__InfluenzaA__ADM95836

SEQ ID NO: 158434 - RNA, 1701 nt, Artificial Sequence; identical to SEQ ID NO: 157786
  derived and/or modified sequence opt4 from hemagglutinin__InfluenzaA__ADM95837

SEQ ID NO: 158435 - RNA, 1701 nt, Artificial Sequence
  derived and/or modified sequence opt4 from hemagglutinin__InfluenzaA__ADM95838
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugccugcacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158436 - RNA, 1701 nt, Artificial Sequence; identical to SEQ ID NO: 156871
  derived and/or modified sequence opt4 from hemagglutinin__InfluenzaA__ADM95839

SEQ ID NO: 158437 - RNA, 1701 nt, Artificial Sequence; identical to SEQ ID NO: 158396
  derived and/or modified sequence opt4 from hemagglutinin__InfluenzaA__ADM95840

SEQ ID NO: 158438 - RNA, 1701 nt, Artificial Sequence; identical to SEQ ID NO: 158396
  derived and/or modified sequence opt4 from hemagglutinin__InfluenzaA__ADM95842

SEQ ID NO: 158439 - RNA, 1701 nt, Artificial Sequence; identical to SEQ ID NO: 157786
  derived and/or modified sequence opt4 from hemagglutinin__InfluenzaA__ADM95843

SEQ ID NO: 158440 - RNA, 1701 nt, Artificial Sequence; identical to SEQ ID NO: 157786
  derived and/or modified sequence opt4 from hemagglutinin__InfluenzaA__ADM95844

SEQ ID NO: 158441 - RNA, 1701 nt, Artificial Sequence
  derived and/or modified sequence opt4 from hemagglutinin__InfluenzaA__ADM95845
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagaauggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggagaccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158442 - RNA, 1701 nt, Artificial Sequence
  derived and/or modified sequence opt4 from hemagglutinin__InfluenzaA__ADM95846
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggaggccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158443 - RNA, 1701 nt, Artificial Sequence; identical to SEQ ID NO: 156290
  derived and/or modified sequence opt4 from hemagglutinin__InfluenzaA__ADM95847

SEQ ID NO: 158444 - RNA, 1701 nt, Artificial Sequence; identical to SEQ ID NO: 156290
  derived and/or modified sequence opt4 from hemagglutinin__InfluenzaA__ADM95848

SEQ ID NO: 158445 - RNA, 1701 nt, Artificial Sequence
  derived and/or modified sequence opt4 from hemagglutinin__InfluenzaA__ADM95849
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaagcuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcuggugaucagccugggcgccaucagcuucuggaugugcagcaacggcagccugcagugcagaaucugcaucuga

SEQ ID NO: 158446 - RNA, 1701 nt, Artificial Sequence; identical to SEQ ID NO: 157786
  derived and/or modified sequence opt4 from hemagglutinin__InfluenzaA__ADM95850

SEQ ID NO: 158447 - RNA, 1701 nt, Artificial Sequence
  derived and/or modified sequence opt4 from hemagglutinin__InfluenzaA__ADM95851
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccaccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158448 - RNA, 1701 nt, Artificial Sequence
  derived and/or modified sequence opt4 from hemagglutinin__InfluenzaA__ADM95852
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaagcuguacgagaagaucagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158449 - RNA, 1701 nt, Artificial Sequence; identical to SEQ ID NO: 156609
  derived and/or modified sequence opt4 from hemagglutinin__InfluenzaA__ADM95854

SEQ ID NO: 158450 - RNA, 1701 nt, Artificial Sequence
  derived and/or modified sequence opt4 from hemagglutinin__InfluenzaA__ADM95855
augaaggccauccugguggugcugcuguacaccuucgccaccaccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaagcuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158451 - RNA, 1701 nt, Artificial Sequence
  derived and/or modified sequence opt4 from hemagglutinin__InfluenzaA__ADM95857
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccaacagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagaauggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158452 - RNA, 1701 nt, Artificial Sequence; identical to SEQ ID NO: 156871
  derived and/or modified sequence opt4 from hemagglutinin__InfluenzaA__ADM95858

SEQ ID NO: 158453 - RNA, 1701 nt, Artificial Sequence
  derived and/or modified sequence opt4 from hemagglutinin__InfluenzaA__ADM95859
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacgagaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaagcuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158454 - RNA, 1701 nt, Artificial Sequence; identical to SEQ ID NO: 156816
  derived and/or modified sequence opt4 from hemagglutinin__InfluenzaA__ADM95860

SEQ ID NO: 158455 - RNA, 1701 nt, Artificial Sequence; identical to SEQ ID NO: 158416
  derived and/or modified sequence opt4 from hemagglutinin__InfluenzaA__ADM95862

SEQ ID NO: 158456 - RNA, 1701 nt, Artificial Sequence
  derived and/or modified sequence opt4 from hemagglutinin__InfluenzaA__ADM95864
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccagagugagagaccaggagggcagaaugaacuaccacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158457 - RNA, 1701 nt, Artificial Sequence; identical to SEQ ID NO: 156741
  derived and/or modified sequence opt4 from hemagglutinin__InfluenzaA__ADM95865

SEQ ID NO: 158458 - RNA, 1701 nt, Artificial Sequence
  derived and/or modified sequence opt4 from hemagglutinin__InfluenzaA__ADM95866
augaaggccauccugguggugcugcuguacaccuucgccaccaccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaucagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggugaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccgccgccagcagccuggugcugguggugagccugggcgccaucagcuucuggaugugcagcaacggcagccugcagugcagaaucugcaucuga

SEQ ID NO: 158459 - RNA, 1698 nt, Artificial Sequence; identical to SEQ ID NO: 158033
  derived and/or modified sequence opt4 from hemagglutinin__InfluenzaA__ADN06300

SEQ ID NO: 158460 - RNA, 1698 nt, Artificial Sequence
  derived and/or modified sequence opt4 from hemagglutinin__InfluenzaA__ADN06311
augaaggugaagcugcuggugcugcugugcacccugaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaagggcagcagcuggcccaaccacaccgugaccggcgugagcgccagcugcagccacaacggcgagaacagcuucuacagaaaccugcuguggcugaccggcaagaacggccuguaccccaaccugagcaagagcuacgccaacaacaaggagaaggaggugcuggugcuguggggcgugcaccacccccccaacaucgccgaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 158461 - RNA, 1698 nt, Artificial Sequence
  derived and/or modified sequence opt4 from hemagglutinin__InfluenzaA__ADN06322
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaugguggaccagagaacccuguacagaaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccaugggcaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 158462 - RNA, 1698 nt, Artificial Sequence
  derived and/or modified sequence opt4 from hemagglutinin__InfluenzaA__ADN06344
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccagcaucagcgaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 158463 - RNA, 1701 nt, Artificial Sequence; identical to SEQ ID NO: 158053
  derived and/or modified sequence opt4 from hemagglutinin__InfluenzaA__ADN06366

SEQ ID NO: 158464 - RNA, 1701 nt, Artificial Sequence
  derived and/or modified sequence opt4 from hemagglutinin__InfluenzaA__ADN26165
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggagggcaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcugaucaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcgccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158465 - RNA, 1701 nt, Artificial Sequence; identical to SEQ ID NO: 155369
  derived and/or modified sequence opt4 from hemagglutinin__InfluenzaA__ADN26175

SEQ ID NO: 158466 - RNA, 1701 nt, Artificial Sequence
  derived and/or modified sequence opt4 from hemagglutinin__InfluenzaA__ADN78194
augaaggccauccugguggugcugcuguacaccuucgccaccaccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggccugcuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158467 - RNA, 1701 nt, Artificial Sequence; identical to SEQ ID NO: 156353
  derived and/or modified sequence opt4 from hemagglutinin__InfluenzaA__ADN78195

SEQ ID NO: 158468 - RNA, 1701 nt, Artificial Sequence; identical to SEQ ID NO: 156741
  derived and/or modified sequence opt4 from hemagglutinin__InfluenzaA__ADN78212

SEQ ID NO: 158469 - RNA, 1701 nt, Artificial Sequence; identical to SEQ ID NO: 156741
  derived and/or modified sequence opt4 from hemagglutinin__InfluenzaA__ADN78221

SEQ ID NO: 158470 - RNA, 1698 nt, Artificial Sequence; identical to SEQ ID NO: 158460
  derived and/or modified sequence opt4 from hemagglutinin__InfluenzaA__ADN89050

SEQ ID NO: 158471 - RNA, 1698 nt, Artificial Sequence
  derived and/or modified sequence opt4 from hemagglutinin__InfluenzaA__ADN89061
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccgagaagaacggccuguaccccaaccugagcaagagcuacgccaacaacaaggagaaggaggugcuggugcuguggggcgugcaccacccccccagcaucagcgaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacgagaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagaaccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 158472 - RNA, 1698 nt, Artificial Sequence; identical to SEQ ID NO: 158462
  derived and/or modified sequence opt4 from hemagglutinin__InfluenzaA__ADN89072

SEQ ID NO: 158473 - RNA, 1698 nt, Artificial Sequence
  derived and/or modified sequence opt4 from hemagglutinin__InfluenzaA__ADN89083
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagaacagcuucuacagaaaccugcuguggcugaccggcaagaacggccuguaccccaaccugagcaagagcuacgccaacaacaaggagaaggaggugcuggugcuguggggcgugcaccacccccccaacauggccgaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 158474 - RNA, 1698 nt, Artificial Sequence
  derived and/or modified sequence opt4 from hemagglutinin__InfluenzaA__ADN89094
augaaggugaagcugcuggugcugcugugcaccuucaccgccaccuacgccgacaccaucugcaucggcuaccacgccaacaacagcaccgacaccguggacaccgcccuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagaacagcuucuacagaaaccugcuguggcugaccggcaagaacggccuguaccccaaccugagcaagagcuacgccaacaacaagggcaaggaggugcuggugcuguggggcgugcaccacccccccaacaucgccgaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 158475 - RNA, 1698 nt, Artificial Sequence
  derived and/or modified sequence opt4 from hemagglutinin__InfluenzaA__ADN89116
augaaggugaagcugcugauccugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccgugaagaacggccuguaccccaaccugagcaagagcuacgccaacaacaaggagaaggaggugcuggugcuguggggcgugcaccacccccccaacaucguggaccagaagacccuguacagaaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagacccccagaggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaaccuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 158476 - RNA, 1698 nt, Artificial Sequence
  derived and/or modified sequence opt4 from hemagglutinin__InfluenzaA__ADN89127
augaaggugaagcugcuggugcugcugugcacccugaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaagggcagcagcuggcccaaccacaccgugaccggcgugagcgccagcugcagccacaacggcgagaacagcuucuacagaaaccugcuguggcugaccggcaagaacggccuguaccccaaccugagcaagagcuacgccaacaacaaggagaaggaggugcuggugcuguggggcgugcaccacccccccaacaucgccgaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccgaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 158477 - RNA, 1698 nt, Artificial Sequence
  derived and/or modified sequence opt4 from hemagglutinin__InfluenzaA__ADN89149
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccgagaagaacggccuguaccccaaccugagcaagagcuacgccaacaacaaggagaaggaggugcuggugcuguggggcgugcaccacccccccagcaucagcgaccagaagacccuguaccacaccgagaacgccuacgugagcguggugagcagccacuacagcagaaaguucacccccgagguggccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 158478 - RNA, 1698 nt, Artificial Sequence; identical to SEQ ID NO: 158033
  derived and/or modified sequence opt4 from hemagglutinin__InfluenzaA__ADN89171

SEQ ID NO: 158479 - RNA, 1698 nt, Artificial Sequence
  derived and/or modified sequence opt4 from hemagglutinin__InfluenzaA__ADN89182
augaaggugaagcugcuggugcugcugugcacccugaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucguggaccagaagacccuguacagaaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 158480 - RNA, 1698 nt, Artificial Sequence; identical to SEQ ID NO: 158033
  derived and/or modified sequence opt4 from hemagglutinin__InfluenzaA__ADN89193

SEQ ID NO: 158481 - RNA, 1698 nt, Artificial Sequence; identical to SEQ ID NO: 158033
  derived and/or modified sequence opt4 from hemagglutinin__InfluenzaA__ADN89204

SEQ ID NO: 158482 - RNA, 1698 nt, Artificial Sequence; identical to SEQ ID NO: 158460
  derived and/or modified sequence opt4 from hemagglutinin__InfluenzaA__ADN89215

SEQ ID NO: 158483 - RNA, 1698 nt, Artificial Sequence
  derived and/or modified sequence opt4 from hemagglutinin__InfluenzaA__ADN89226
augaaggugaagcugcuggugcugcugugcaccuucgccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccgagaagaacggccuguaccccaaccugagcaagagcuacgccaacaacaaggagaaggaggugcuggugcuguggggcgugcaccacccccccagcaucagcgaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugaacagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcgugcagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagaaccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 158484 - RNA, 1698 nt, Artificial Sequence; identical to SEQ ID NO: 158460
  derived and/or modified sequence opt4 from hemagglutinin__InfluenzaA__ADN89237

SEQ ID NO: 158485 - RNA, 1698 nt, Artificial Sequence
  derived and/or modified sequence opt4 from hemagglutinin__InfluenzaA__ADN89248
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcaucgccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccagcaucagcgaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 158486 - RNA, 1698 nt, Artificial Sequence; identical to SEQ ID NO: 158473
  derived and/or modified sequence opt4 from hemagglutinin__InfluenzaA__ADN89259

SEQ ID NO: 158487 - RNA, 1698 nt, Artificial Sequence
  derived and/or modified sequence opt4 from hemagglutinin__InfluenzaA__ADN89281
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccgagaagaacggccuguaccccaaccugagcaagagcuacgccaacaacaaggagaaggaggugcuggugcuguggggcgugcaccacccccccagcaucagcgaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagaaccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 158488 - RNA, 1698 nt, Artificial Sequence; identical to SEQ ID NO: 158487
  derived and/or modified sequence opt4 from hemagglutinin__InfluenzaA__ADN89292

SEQ ID NO: 158489 - RNA, 1698 nt, Artificial Sequence; identical to SEQ ID NO: 158487
  derived and/or modified sequence opt4 from hemagglutinin__InfluenzaA__ADN89303

SEQ ID NO: 158490 - RNA, 1698 nt, Artificial Sequence; identical to SEQ ID NO: 156146
  derived and/or modified sequence opt4 from hemagglutinin__InfluenzaA__ADN89314

SEQ ID NO: 158491 - RNA, 1698 nt, Artificial Sequence; identical to SEQ ID NO: 155651
  derived and/or modified sequence opt4 from hemagglutinin__InfluenzaA__ADN89325

SEQ ID NO: 158492 - RNA, 1698 nt, Artificial Sequence
  derived and/or modified sequence opt4 from hemagglutinin__InfluenzaA__ADN89336
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagaagcuucuacagaaaccugcuguggcugaccggcaagaacggccuguaccccaaccugagcaagagcuacgccaacaacaaggagaaggaggugcuggugcuguggggcgugcaccacccccccgacaucggcgaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 158493 - RNA, 1698 nt, Artificial Sequence; identical to SEQ ID NO: 158483
  derived and/or modified sequence opt4 from hemagglutinin__InfluenzaA__ADN89347

SEQ ID NO: 158494 - RNA, 1698 nt, Artificial Sequence; identical to SEQ ID NO: 155651
  derived and/or modified sequence opt4 from hemagglutinin__InfluenzaA__ADN89358

SEQ ID NO: 158495 - RNA, 1698 nt, Artificial Sequence
  derived and/or modified sequence opt4 from hemagglutinin__InfluenzaA__ADN89369
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccgugaagaacggccuguaccccaaccugagcaagagcuacgccaacaacaaggagaaggaggugcuggugcuguggggcgugcaccacccccccaacaucguggaccagaagacccuguacagaaccgagaacgccuacgugagcguggugagcagccacuacagcagaaaguucauccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagacccccagaggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 158496 - RNA, 1698 nt, Artificial Sequence
  derived and/or modified sequence opt4 from hemagglutinin__InfluenzaA__ADN89380
augaaggugaagcugcuggugcugcugugcacccugaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucguggaccagaagacccuguacagaaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 158497 - RNA, 1698 nt, Artificial Sequence
  derived and/or modified sequence opt4 from hemagglutinin__InfluenzaA__ADN89391
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagaagcuucuacaagaaccugcuguggcugaccggcaagaacggccuguaccccaaccugagcaagagcuacgccaacaacaaggagaaggaggugcuggugcuguggggcgugcaccacccccccgacaucggcgaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 158498 - RNA, 1698 nt, Artificial Sequence
  derived and/or modified sequence opt4 from hemagglutinin__InfluenzaA__ADN89402
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaagaagagcuggagcuacaucguggagaagcccaaccccgagaacggcaccugcuaccccggccacuucgccgacuacgaggagcugaaggagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucguggaccagaagacccuguacagaaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccaugggcaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 158499 - RNA, 1698 nt, Artificial Sequence; identical to SEQ ID NO: 158460
  derived and/or modified sequence opt4 from hemagglutinin__InfluenzaA__ADN89413

SEQ ID NO: 158500 - RNA, 1698 nt, Artificial Sequence; identical to SEQ ID NO: 158033
  derived and/or modified sequence opt4 from hemagglutinin__InfluenzaA__ADN89424

SEQ ID NO: 158501 - RNA, 1698 nt, Artificial Sequence
  derived and/or modified sequence opt4 from hemagglutinin__InfluenzaA__ADN89435
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagaacagcuucuacagaaaccugcuguggcugaccggcaagaacggccuguaccccaaccugagcaagagcuacgccaacaacaaggagaaggaggugcuggugcuguggggcgugcaccacccccccaacaucgccgaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcagacugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 158502 - RNA, 1698 nt, Artificial Sequence
  derived and/or modified sequence opt4 from hemagglutinin__InfluenzaA__ADN89446
augaaggccaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagaacagcuucuacagaaaccugcuguggcugaccggcaagaacggccuguaccccaaccugagcaagagcuacgccaacaacaaggagaaggaggugcuggugcuguggggcgugcaccacccccccaacaucgccgaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 158503 - RNA, 1698 nt, Artificial Sequence; identical to SEQ ID NO: 158033
  derived and/or modified sequence opt4 from hemagglutinin__InfluenzaA__ADN89457

SEQ ID NO: 158504 - RNA, 1698 nt, Artificial Sequence
  derived and/or modified sequence opt4 from hemagglutinin__InfluenzaA__ADN89468
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggacagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccagcaucaacgaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucagcaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccugaccaucuacagcaccguggccagcagccuggugcugcugaucagccugggcgccaucagcuucuggaugugcagcaacggcagccugcagugcagaaucugcaucuga

SEQ ID NO: 158505 - RNA, 1698 nt, Artificial Sequence; identical to SEQ ID NO: 158462
  derived and/or modified sequence opt4 from hemagglutinin__InfluenzaA__ADN89479

SEQ ID NO: 158506 - RNA, 1698 nt, Artificial Sequence; identical to SEQ ID NO: 158462
  derived and/or modified sequence opt4 from hemagglutinin__InfluenzaA__ADN89490

SEQ ID NO: 158507 - RNA, 1698 nt, Artificial Sequence; identical to SEQ ID NO: 158485
  derived and/or modified sequence opt4 from hemagglutinin__InfluenzaA__ADN89501

SEQ ID NO: 158508 - RNA, 1698 nt, Artificial Sequence; identical to SEQ ID NO: 158473
  derived and/or modified sequence opt4 from hemagglutinin__InfluenzaA__ADN89512

SEQ ID NO: 158509 - RNA, 1698 nt, Artificial Sequence; identical to SEQ ID NO: 158487
  derived and/or modified sequence opt4 from hemagglutinin__InfluenzaA__ADN89523

SEQ ID NO: 158510 - RNA, 1698 nt, Artificial Sequence; identical to SEQ ID NO: 158496
  derived and/or modified sequence opt4 from hemagglutinin__InfluenzaA__ADN89534

SEQ ID NO: 158511 - RNA, 1698 nt, Artificial Sequence; identical to SEQ ID NO: 158501
  derived and/or modified sequence opt4 from hemagglutinin__InfluenzaA__ADN89545

SEQ ID NO: 158512 - RNA, 1698 nt, Artificial Sequence; identical to SEQ ID NO: 156146
  derived and/or modified sequence opt4 from hemagglutinin__InfluenzaA__ADN89556

SEQ ID NO: 158513 - RNA, 1698 nt, Artificial Sequence; identical to SEQ ID NO: 158462
  derived and/or modified sequence opt4 from hemagglutinin__InfluenzaA__ADN89567

SEQ ID NO: 158514 - RNA, 1698 nt, Artificial Sequence
  derived and/or modified sequence opt4 from hemagglutinin__InfluenzaA__ADN89578
augaaggugaagcugcuggugcugcugugcacccugaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaagggcagcagcuggcccaaccacaccgugaccggcgugagcgccagcugcagccacaacggcgagaacagcuucuacagaaaccugcuguggcugaccggcaagaacggccuguaccccaaccugagcaagagcuacgccaacaacaaggagaaggaggugcugcugcuguggggcgugcaccacccccccaacaucgccgaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 158515 - RNA, 1698 nt, Artificial Sequence; identical to SEQ ID NO: 158033
  derived and/or modified sequence opt4 from hemagglutinin__InfluenzaA__ADN89589

SEQ ID NO: 158516 - RNA, 1698 nt, Artificial Sequence
  derived and/or modified sequence opt4 from hemagglutinin__InfluenzaA__ADN89600
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccagaaagaacggccuguaccccaaccugagcaagagcuacgccaacaacaaggagaaggaggugcuggugcuguggggcgugcaccacccccccaacaugguggaccagaagacccuguacagaaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccaugggcaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 158517 - RNA, 1698 nt, Artificial Sequence; identical to SEQ ID NO: 158033
  derived and/or modified sequence opt4 from hemagglutinin__InfluenzaA__ADN89611

SEQ ID NO: 158518 - RNA, 1698 nt, Artificial Sequence; identical to SEQ ID NO: 158460
  derived and/or modified sequence opt4 from hemagglutinin__InfluenzaA__ADN89622

SEQ ID NO: 158519 - RNA, 1698 nt, Artificial Sequence; identical to SEQ ID NO: 158501
  derived and/or modified sequence opt4 from hemagglutinin__InfluenzaA__ADN89633

SEQ ID NO: 158520 - RNA, 1698 nt, Artificial Sequence; identical to SEQ ID NO: 158485
  derived and/or modified sequence opt4 from hemagglutinin__InfluenzaA__ADN89644

SEQ ID NO: 158521 - RNA, 1698 nt, Artificial Sequence; identical to SEQ ID NO: 158501
  derived and/or modified sequence opt4 from hemagglutinin__InfluenzaA__ADN89655

SEQ ID NO: 158522 - RNA, 1698 nt, Artificial Sequence; identical to SEQ ID NO: 158033
  derived and/or modified sequence opt4 from hemagglutinin__InfluenzaA__ADN89666

SEQ ID NO: 158523 - RNA, 1698 nt, Artificial Sequence; identical to SEQ ID NO: 158473
  derived and/or modified sequence opt4 from hemagglutinin__InfluenzaA__ADN89677

SEQ ID NO: 158524 - RNA, 1698 nt, Artificial Sequence; identical to SEQ ID NO: 158473
  derived and/or modified sequence opt4 from hemagglutinin__InfluenzaA__ADN89688

SEQ ID NO: 158525 - RNA, 1698 nt, Artificial Sequence; identical to SEQ ID NO: 158460
  derived and/or modified sequence opt4 from hemagglutinin__InfluenzaA__ADN89699

SEQ ID NO: 158526 - RNA, 1698 nt, Artificial Sequence; identical to SEQ ID NO: 158462
  derived and/or modified sequence opt4 from hemagglutinin__InfluenzaA__ADN89710

SEQ ID NO: 158527 - RNA, 1698 nt, Artificial Sequence; identical to SEQ ID NO: 158485
  derived and/or modified sequence opt4 from hemagglutinin__InfluenzaA__ADN89721

SEQ ID NO: 158528 - RNA, 1698 nt, Artificial Sequence; identical to SEQ ID NO: 158462
  derived and/or modified sequence opt4 from hemagglutinin__InfluenzaA__ADN89732

SEQ ID NO: 158529 - RNA, 1698 nt, Artificial Sequence; identical to SEQ ID NO: 158462
  derived and/or modified sequence opt4 from hemagglutinin__InfluenzaA__ADN89743

SEQ ID NO: 158530 - RNA, 1698 nt, Artificial Sequence; identical to SEQ ID NO: 158487
  derived and/or modified sequence opt4 from hemagglutinin__InfluenzaA__ADN89765

SEQ ID NO: 158531 - RNA, 1698 nt, Artificial Sequence
  derived and/or modified sequence opt4 from hemagglutinin__InfluenzaA__ADN89776
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccagcaucagcgaccagaagacccuguaccacaccgagaacgccuacgugagcguggugagcagccacuacagcagaaaguucacccccgagguggccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 158532 - RNA, 1698 nt, Artificial Sequence; identical to SEQ ID NO: 158473
  derived and/or modified sequence opt4 from hemagglutinin__InfluenzaA__ADN89787

SEQ ID NO: 158533 - RNA, 1698 nt, Artificial Sequence; identical to SEQ ID NO: 158487
  derived and/or modified sequence opt4 from hemagglutinin__InfluenzaA__ADN89798

SEQ ID NO: 158534 - RNA, 1698 nt, Artificial Sequence; identical to SEQ ID NO: 158033
  derived and/or modified sequence opt4 from hemagglutinin__InfluenzaA__ADN89809

SEQ ID NO: 158535 - RNA, 1698 nt, Artificial Sequence; identical to SEQ ID NO: 158033
  derived and/or modified sequence opt4 from hemagglutinin__InfluenzaA__ADN89820

SEQ ID NO: 158536 - RNA, 1698 nt, Artificial Sequence; identical to SEQ ID NO: 158033
  derived and/or modified sequence opt4 from hemagglutinin__InfluenzaA__ADN89831

SEQ ID NO: 158537 - RNA, 1698 nt, Artificial Sequence
  derived and/or modified sequence opt4 from hemagglutinin__InfluenzaA__ADN89842
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagacacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucguggaccagaagacccuguacagaaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 158538 - RNA, 1701 nt, Artificial Sequence; identical to SEQ ID NO: 158053
  derived and/or modified sequence opt4 from hemagglutinin__InfluenzaA__ADN89864

SEQ ID NO: 158539 - RNA, 1701 nt, Artificial Sequence; identical to SEQ ID NO: 158053
  derived and/or modified sequence opt4 from hemagglutinin__InfluenzaA__ADN89875

SEQ ID NO: 158540 - RNA, 1701 nt, Artificial Sequence
  derived and/or modified sequence opt4 from hemagglutinin__InfluenzaA__ADN89886
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaccaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 158541 - RNA, 1701 nt, Artificial Sequence; identical to SEQ ID NO: 158053
  derived and/or modified sequence opt4 from hemagglutinin__InfluenzaA__ADN89897

SEQ ID NO: 158542 - RNA, 1701 nt, Artificial Sequence; identical to SEQ ID NO: 158053
  derived and/or modified sequence opt4 from hemagglutinin__InfluenzaA__ADN89908

SEQ ID NO: 158543 - RNA, 1701 nt, Artificial Sequence; identical to SEQ ID NO: 158053
  derived and/or modified sequence opt4 from hemagglutinin__InfluenzaA__ADN89919

SEQ ID NO: 158544 - RNA, 1701 nt, Artificial Sequence; identical to SEQ ID NO: 158053
  derived and/or modified sequence opt4 from hemagglutinin__InfluenzaA__ADN89930

SEQ ID NO: 158545 - RNA, 1701 nt, Artificial Sequence; identical to SEQ ID NO: 158053
  derived and/or modified sequence opt4 from hemagglutinin__InfluenzaA__ADN89941

SEQ ID NO: 158546 - RNA, 1701 nt, Artificial Sequence; identical to SEQ ID NO: 158053
  derived and/or modified sequence opt4 from hemagglutinin__InfluenzaA__ADN89952

SEQ ID NO: 158547 - RNA, 1701 nt, Artificial Sequence; identical to SEQ ID NO: 158053
  derived and/or modified sequence opt4 from hemagglutinin__InfluenzaA__ADN89963

SEQ ID NO: 158548 - RNA, 1701 nt, Artificial Sequence
  derived and/or modified sequence opt4 from hemagglutinin__InfluenzaA__ADN89974
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagauccagagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaccaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 158549 - RNA, 1701 nt, Artificial Sequence; identical to SEQ ID NO: 158053
  derived and/or modified sequence opt4 from hemagglutinin__InfluenzaA__ADN89985

SEQ ID NO: 158550 - RNA, 1701 nt, Artificial Sequence; identical to SEQ ID NO: 158053
  derived and/or modified sequence opt4 from hemagglutinin__InfluenzaA__ADN89996

SEQ ID NO: 158551 - RNA, 1701 nt, Artificial Sequence; identical to SEQ ID NO: 158053
  derived and/or modified sequence opt4 from hemagglutinin__InfluenzaA__ADN90007

SEQ ID NO: 158552 - RNA, 1701 nt, Artificial Sequence; identical to SEQ ID NO: 158053
  derived and/or modified sequence opt4 from hemagglutinin__InfluenzaA__ADN90018

SEQ ID NO: 158553 - RNA, 1701 nt, Artificial Sequence; identical to SEQ ID NO: 158053
  derived and/or modified sequence opt4 from hemagglutinin__InfluenzaA__ADN90040

SEQ ID NO: 158554 - RNA, 1701 nt, Artificial Sequence; identical to SEQ ID NO: 158053
  derived and/or modified sequence opt4 from hemagglutinin__InfluenzaA__ADN90051

SEQ ID NO: 158555 - RNA, 1701 nt, Artificial Sequence; identical to SEQ ID NO: 158053
  derived and/or modified sequence opt4 from hemagglutinin__InfluenzaA__ADN90062

SEQ ID NO: 158556 - RNA, 1701 nt, Artificial Sequence; identical to SEQ ID NO: 158053
  derived and/or modified sequence opt4 from hemagglutinin__InfluenzaA__ADN90073

SEQ ID NO: 158557 - RNA, 1701 nt, Artificial Sequence; identical to SEQ ID NO: 158053
  derived and/or modified sequence opt4 from hemagglutinin__InfluenzaA__ADN90084

SEQ ID NO: 158558 - RNA, 1701 nt, Artificial Sequence; identical to SEQ ID NO: 158053
  derived and/or modified sequence opt4 from hemagglutinin__InfluenzaA__ADN90095

SEQ ID NO: 158559 - RNA, 1701 nt, Artificial Sequence; identical to SEQ ID NO: 158053
  derived and/or modified sequence opt4 from hemagglutinin__InfluenzaA__ADN90106

SEQ ID NO: 158560 - RNA, 1701 nt, Artificial Sequence; identical to SEQ ID NO: 158053
  derived and/or modified sequence opt4 from hemagglutinin__InfluenzaA__ADN90117

SEQ ID NO: 158561 - RNA, 1701 nt, Artificial Sequence; identical to SEQ ID NO: 158053
  derived and/or modified sequence opt4 from hemagglutinin__InfluenzaA__ADN90128

SEQ ID NO: 158562 - RNA, 1701 nt, Artificial Sequence; identical to SEQ ID NO: 158053
  derived and/or modified sequence opt4 from hemagglutinin__InfluenzaA__ADN90139

SEQ ID NO: 158563 - RNA, 1701 nt, Artificial Sequence; identical to SEQ ID NO: 158053
  derived and/or modified sequence opt4 from hemagglutinin__InfluenzaA__ADN90150

SEQ ID NO: 158564 - RNA, 1701 nt, Artificial Sequence; identical to SEQ ID NO: 158053
  derived and/or modified sequence opt4 from hemagglutinin__InfluenzaA__ADN90161

SEQ ID NO: 158565 - RNA, 1701 nt, Artificial Sequence; identical to SEQ ID NO: 158053
  derived and/or modified sequence opt4 from hemagglutinin__InfluenzaA__ADN90172

SEQ ID NO: 158566 - RNA, 1701 nt, Artificial Sequence; identical to SEQ ID NO: 158053
  derived and/or modified sequence opt4 from hemagglutinin__InfluenzaA__ADN90183

SEQ ID NO: 158567 - RNA, 1701 nt, Artificial Sequence; identical to SEQ ID NO: 158053
  derived and/or modified sequence opt4 from hemagglutinin__InfluenzaA__ADN90194

SEQ ID NO: 158568 - RNA, 1701 nt, Artificial Sequence; identical to SEQ ID NO: 158053
  derived and/or modified sequence opt4 from hemagglutinin__InfluenzaA__ADN90205

SEQ ID NO: 158569 - RNA, 1701 nt, Artificial Sequence; identical to SEQ ID NO: 158053
  derived and/or modified sequence opt4 from hemagglutinin__InfluenzaA__ADN90216

SEQ ID NO: 158570 - RNA, 1701 nt, Artificial Sequence; identical to SEQ ID NO: 155950
  derived and/or modified sequence opt4 from hemagglutinin__InfluenzaA__ADN92467

SEQ ID NO: 158571 - RNA, 1701 nt, Artificial Sequence
  derived and/or modified sequence opt4 from hemagglutinin__InfluenzaA__ADN92478
augaagaccaucaucgcccugagccacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccaggcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagauccagagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 158572 - RNA, 1701 nt, Artificial Sequence
  derived and/or modified sequence opt4 from hemagglutinin__InfluenzaA__ADN92489
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagaacuucaacuggaccggcgugacccagaacggcaccagcagcgccugcaucagaagaagcaagaacagcuucuucagcagacugaacuggcugacccaccugaacuucaaguaccaggcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagauccagagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 158573 - RNA, 1701 nt, Artificial Sequence; identical to SEQ ID NO: 155950
  derived and/or modified sequence opt4 from hemagglutinin__InfluenzaA__ADN92500

SEQ ID NO: 158574 - RNA, 1701 nt, Artificial Sequence; identical to SEQ ID NO: 155189
  derived and/or modified sequence opt4 from hemagglutinin__InfluenzaA__ADN92510

SEQ ID NO: 158575 - RNA, 1701 nt, Artificial Sequence; identical to SEQ ID NO: 155189
  derived and/or modified sequence opt4 from hemagglutinin__InfluenzaA__ADN92520

SEQ ID NO: 158576 - RNA, 1701 nt, Artificial Sequence; identical to SEQ ID NO: 156291
  derived and/or modified sequence opt4 from hemagglutinin__InfluenzaA__ADN92530

SEQ ID NO: 158577 - RNA, 1701 nt, Artificial Sequence; identical to SEQ ID NO: 155431
  derived and/or modified sequence opt4 from hemagglutinin__InfluenzaA__ADN92540

SEQ ID NO: 158578 - RNA, 1701 nt, Artificial Sequence; identical to SEQ ID NO: 155189
  derived and/or modified sequence opt4 from hemagglutinin__InfluenzaA__ADN92550

SEQ ID NO: 158579 - RNA, 1701 nt, Artificial Sequence; identical to SEQ ID NO: 155189
  derived and/or modified sequence opt4 from hemagglutinin__InfluenzaA__ADN92560

SEQ ID NO: 158580 - RNA, 1701 nt, Artificial Sequence
  derived and/or modified sequence opt4 from hemagglutinin__InfluenzaA__ADO00730
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcggcagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacggcaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158581 - RNA, 1701 nt, Artificial Sequence; identical to SEQ ID NO: 156609
  derived and/or modified sequence opt4 from hemagglutinin__InfluenzaA__ADO00740

SEQ ID NO: 158582 - RNA, 1701 nt, Artificial Sequence; identical to SEQ ID NO: 156353
  derived and/or modified sequence opt4 from hemagglutinin__InfluenzaA__ADO00750

SEQ ID NO: 158583 - RNA, 1701 nt, Artificial Sequence; identical to SEQ ID NO: 155189
  derived and/or modified sequence opt4 from hemagglutinin__InfluenzaA__ADO12143

SEQ ID NO: 158584 - RNA, 1701 nt, Artificial Sequence; identical to SEQ ID NO: 155189
  derived and/or modified sequence opt4 from hemagglutinin__InfluenzaA__ADO12153

SEQ ID NO: 158585 - RNA, 1701 nt, Artificial Sequence; identical to SEQ ID NO: 155189
  derived and/or modified sequence opt4 from hemagglutinin__InfluenzaA__ADO12163

SEQ ID NO: 158586 - RNA, 1701 nt, Artificial Sequence; identical to SEQ ID NO: 155189
  derived and/or modified sequence opt4 from hemagglutinin__InfluenzaA__ADO12173

SEQ ID NO: 158587 - RNA, 1701 nt, Artificial Sequence; identical to SEQ ID NO: 155189
  derived and/or modified sequence opt4 from hemagglutinin__InfluenzaA__ADO12183

SEQ ID NO: 158588 - RNA, 1701 nt, Artificial Sequence; identical to SEQ ID NO: 155189
  derived and/or modified sequence opt4 from hemagglutinin__InfluenzaA__ADO12193

SEQ ID NO: 158589 - RNA, 1701 nt, Artificial Sequence; identical to SEQ ID NO: 155189
  derived and/or modified sequence opt4 from hemagglutinin__InfluenzaA__ADO12203

SEQ ID NO: 158590 - RNA, 1701 nt, Artificial Sequence; identical to SEQ ID NO: 155189
  derived and/or modified sequence opt4 from hemagglutinin__InfluenzaA__ADO12213

SEQ ID NO: 158591 - RNA, 1701 nt, Artificial Sequence; identical to SEQ ID NO: 155189
  derived and/or modified sequence opt4 from hemagglutinin__InfluenzaA__ADO12223

SEQ ID NO: 158592 - RNA, 1701 nt, Artificial Sequence; identical to SEQ ID NO: 155189
  derived and/or modified sequence opt4 from hemagglutinin__InfluenzaA__ADO12233

SEQ ID NO: 158593 - RNA, 1701 nt, Artificial Sequence; identical to SEQ ID NO: 155189
  derived and/or modified sequence opt4 from hemagglutinin__InfluenzaA__ADO12243

SEQ ID NO: 158594 - RNA, 1701 nt, Artificial Sequence; identical to SEQ ID NO: 155189
  derived and/or modified sequence opt4 from hemagglutinin__InfluenzaA__ADO12253

SEQ ID NO: 158595 - RNA, 1701 nt, Artificial Sequence; identical to SEQ ID NO: 155189
  derived and/or modified sequence opt4 from hemagglutinin__InfluenzaA__ADO12263

SEQ ID NO: 158596 - RNA, 1701 nt, Artificial Sequence; identical to SEQ ID NO: 155189
  derived and/or modified sequence opt4 from hemagglutinin__InfluenzaA__ADO12273

SEQ ID NO: 158597 - RNA, 1701 nt, Artificial Sequence; identical to SEQ ID NO: 155189
  derived and/or modified sequence opt4 from hemagglutinin__InfluenzaA__ADO12283

SEQ ID NO: 158598 - RNA, 1701 nt, Artificial Sequence; identical to SEQ ID NO: 155189
  derived and/or modified sequence opt4 from hemagglutinin__InfluenzaA__ADO12293

SEQ ID NO: 158599 - RNA, 1701 nt, Artificial Sequence; identical to SEQ ID NO: 155189
  derived and/or modified sequence opt4 from hemagglutinin__InfluenzaA__ADO12303

SEQ ID NO: 158600 - RNA, 1701 nt, Artificial Sequence; identical to SEQ ID NO: 155189
  derived and/or modified sequence opt4 from hemagglutinin__InfluenzaA__ADO12313

SEQ ID NO: 158601 - RNA, 1701 nt, Artificial Sequence; identical to SEQ ID NO: 155189
  derived and/or modified sequence opt4 from hemagglutinin__InfluenzaA__ADO12323

SEQ ID NO: 158602 - RNA, 1701 nt, Artificial Sequence; identical to SEQ ID NO: 155189
  derived and/or modified sequence opt4 from hemagglutinin__InfluenzaA__ADO12333

SEQ ID NO: 158603 - RNA, 1701 nt, Artificial Sequence; identical to SEQ ID NO: 155189
  derived and/or modified sequence opt4 from hemagglutinin__InfluenzaA__ADO12343

SEQ ID NO: 158604 - RNA, 1701 nt, Artificial Sequence; identical to SEQ ID NO: 155189
  derived and/or modified sequence opt4 from hemagglutinin__InfluenzaA__ADO12353

SEQ ID NO: 158605 - RNA, 1701 nt, Artificial Sequence; identical to SEQ ID NO: 155189
  derived and/or modified sequence opt4 from hemagglutinin__InfluenzaA__ADO12363

SEQ ID NO: 158606 - RNA, 1701 nt, Artificial Sequence
  derived and/or modified sequence opt4 from hemagglutinin__InfluenzaA__ADO12373
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacaacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158607 - RNA, 1701 nt, Artificial Sequence; identical to SEQ ID NO: 156674
  derived and/or modified sequence opt4 from hemagglutinin__InfluenzaA__ADO12383

SEQ ID NO: 158608 - RNA, 1701 nt, Artificial Sequence
  derived and/or modified sequence opt4 from hemagglutinin__InfluenzaA__ADO12403
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacgugcaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158609 - RNA, 1701 nt, Artificial Sequence; identical to SEQ ID NO: 156825
  derived and/or modified sequence opt4 from hemagglutinin__InfluenzaA__ADO12413

SEQ ID NO: 158610 - RNA, 1701 nt, Artificial Sequence; identical to SEQ ID NO: 155189
  derived and/or modified sequence opt4 from hemagglutinin__InfluenzaA__ADO12423

SEQ ID NO: 158611 - RNA, 1701 nt, Artificial Sequence; identical to SEQ ID NO: 155189
  derived and/or modified sequence opt4 from hemagglutinin__InfluenzaA__ADO12433

SEQ ID NO: 158612 - RNA, 1701 nt, Artificial Sequence; identical to SEQ ID NO: 155189
  derived and/or modified sequence opt4 from hemagglutinin__InfluenzaA__ADO12443

SEQ ID NO: 158613 - RNA, 1701 nt, Artificial Sequence; identical to SEQ ID NO: 155189
  derived and/or modified sequence opt4 from hemagglutinin__InfluenzaA__ADO12453

SEQ ID NO: 158614 - RNA, 1701 nt, Artificial Sequence; identical to SEQ ID NO: 155189
  derived and/or modified sequence opt4 from hemagglutinin__InfluenzaA__ADO12463

SEQ ID NO: 158615 - RNA, 1701 nt, Artificial Sequence
  derived and/or modified sequence opt4 from hemagglutinin__InfluenzaA__ADO12473
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcagaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158616 - RNA, 1701 nt, Artificial Sequence; identical to SEQ ID NO: 155189
  derived and/or modified sequence opt4 from hemagglutinin__InfluenzaA__ADO12493

SEQ ID NO: 158617 - RNA, 1701 nt, Artificial Sequence
  derived and/or modified sequence opt4 from hemagglutinin__InfluenzaA__ADO12503
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucaacuucuggaugugcagcaacggcagccugcagugcagaaucugcaucuga

SEQ ID NO: 158618 - RNA, 1701 nt, Artificial Sequence
  derived and/or modified sequence opt4 from hemagglutinin__InfluenzaA__ADO12513
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagagagguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158619 - RNA, 1701 nt, Artificial Sequence; identical to SEQ ID NO: 155189
  derived and/or modified sequence opt4 from hemagglutinin__InfluenzaA__ADO12523

SEQ ID NO: 158620 - RNA, 1701 nt, Artificial Sequence
  derived and/or modified sequence opt4 from hemagglutinin__InfluenzaA__ADO12533
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccagacugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158621 - RNA, 1701 nt, Artificial Sequence; identical to SEQ ID NO: 155189
  derived and/or modified sequence opt4 from hemagglutinin__InfluenzaA__ADO12543

SEQ ID NO: 158622 - RNA, 1701 nt, Artificial Sequence; identical to SEQ ID NO: 155189
  derived and/or modified sequence opt4 from hemagglutinin__InfluenzaA__ADO12553

SEQ ID NO: 158623 - RNA, 1701 nt, Artificial Sequence; identical to SEQ ID NO: 155189
  derived and/or modified sequence opt4 from hemagglutinin__InfluenzaA__ADO12563

SEQ ID NO: 158624 - RNA, 1701 nt, Artificial Sequence; identical to SEQ ID NO: 155189
  derived and/or modified sequence opt4 from hemagglutinin__InfluenzaA__ADO12573

SEQ ID NO: 158625 - RNA, 1701 nt, Artificial Sequence
  derived and/or modified sequence opt4 from hemagglutinin__InfluenzaA__ADO12593
augaaggccauccugguggugcugcuguacaccuucgccaccgccaacgccgacacccugugcaucggcuaccacgccaacaacagcaccgacaucguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158626 - RNA, 1701 nt, Artificial Sequence; identical to SEQ ID NO: 155189
  derived and/or modified sequence opt4 from hemagglutinin__InfluenzaA__ADO12603

SEQ ID NO: 158627 - RNA, 1701 nt, Artificial Sequence; identical to SEQ ID NO: 155189
  derived and/or modified sequence opt4 from hemagglutinin__InfluenzaA__ADO12613

SEQ ID NO: 158628 - RNA, 1701 nt, Artificial Sequence; identical to SEQ ID NO: 155189
  derived and/or modified sequence opt4 from hemagglutinin__InfluenzaA__ADO12623

SEQ ID NO: 158629 - RNA, 1701 nt, Artificial Sequence
  derived and/or modified sequence opt4 from hemagglutinin__InfluenzaA__ADO14349
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaagggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaagggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158630 - RNA, 1701 nt, Artificial Sequence; identical to SEQ ID NO: 157453
  derived and/or modified sequence opt4 from hemagglutinin__InfluenzaA__ADO14351

SEQ ID NO: 158631 - RNA, 1701 nt, Artificial Sequence
  derived and/or modified sequence opt4 from hemagglutinin__InfluenzaA__ADO14353
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccgaggccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158632 - RNA, 1701 nt, Artificial Sequence
  derived and/or modified sequence opt4 from hemagglutinin__InfluenzaA__ADO14354
augaaggccauccugguggugcugcuguacaccuucgccaccgccaacgccgacacccugugcaugggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158633 - RNA, 1701 nt, Artificial Sequence
  derived and/or modified sequence opt4 from hemagglutinin__InfluenzaA__ADO14356
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagaggccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccgaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158634 - RNA, 1701 nt, Artificial Sequence; identical to SEQ ID NO: 157453
  derived and/or modified sequence opt4 from hemagglutinin__InfluenzaA__ADO14357

SEQ ID NO: 158635 - RNA, 1701 nt, Artificial Sequence
  derived and/or modified sequence opt4 from hemagglutinin__InfluenzaA__ADO14359
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccacccccccaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158636 - RNA, 1701 nt, Artificial Sequence
  derived and/or modified sequence opt4 from hemagglutinin__InfluenzaA__ADO14361
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaagggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158637 - RNA, 1701 nt, Artificial Sequence
  derived and/or modified sequence opt4 from hemagglutinin__InfluenzaA__ADO14362
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaacagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158638 - RNA, 1683 nt, Artificial Sequence
  derived and/or modified sequence opt4 from hemagglutinin__InfluenzaA__ADO21015
auggagguggugagccugaucaccauccugcugcuggugaccgugagcaacgccgacaagaucugcaucggcuaccagagcaccaacagcaccgagaccguggacacccugaccgagaacaacgugcccguggcccacgccaaggagcugcugcacaccgagcacaacggcaugcugugcgccaccaaccugggccacccccugauccuggacaccugcaccaucgagggccugaucuacggcaaccccagcugcgaccugcugcugggcggcagagaguggagcuacaucguggagagacccagcgccgugaacggccugugcuaccccggcaacguggagaaccuggaggagcugagaagccuguucagcagcgccagcagcuaccagagaauccagaucuuccccggcaccaucuggaacgugagcuacggcggcaccagcaaggccugcagcgacagcuucuacaagagcaugagauggcugacccagaagaacaacgccuaccccauccaggacgcccaguacaccaacaacagaggcaagaacauccuguucauguggggcaucaaccacccccccaccgacaccacccagaccaaccuguacaccagaaccgacaccaccaccagcguggccaccgaggacaucaacagaaccuucaagccccugaucggccccagaccccuggugaacggccagcagggcagaaucgacuacuacuggagcgugcugaagcccggccagacccugagagugagaagcaacggcaaccugaucgcccccugguacggccacauccugagcggcgagagccacggcagaauccugaagaccgaccugaacagcggcaacugcguggugcagugccagaccgagagaggcggccugaacaccacccugcccuuccacaacgugagcaaguacgccuucggcaacugccccaaguacgugggcgugaagagccugaagcuggccgugggccugagaaacgugcccgccagaagcagcagaggccuguucggcgccaucgccggcuucaucgagggcggcuggagcggccugguggccggcugguacggcuuccagcacagcaacgaccagggcgugggcauggccgccgacagagacagcacccagaaggccaucgacaagaucaccagcaaggugaacaacaucguggacaagaugaacaagcaguacgagaucaucgaccacgaguucagcgagguggagaccagacugaacaugaucaacaacaagaucgacgaccagauccaggacaucugggccuacaacgccgagcugcuggugcugcuggagaaccagaagacccuggacgagcacgacgccaacgugaacaaccuguacaacaaggugaagagagcccugggcagcaacgccguggaggacggcaagggcugcuucgagcuguaccacaagugcgacgaccagugcauggagaccaucagaaacggcaccuacaacagaagaaaguacaaggaggagagcagacuggagagacagaagaucgagggcgugaagcuggagagcgagggcaccuacaagauccugaccaucuacagcaccguggccagcagccuggugaucgccaugggcuucgccgccuuccuguucugggccaugagcaacggcagcugcagaugcaacaucugcaucuga

SEQ ID NO: 158639 - RNA, 1683 nt, Artificial Sequence
  derived and/or modified sequence opt4 from hemagglutinin__InfluenzaA__ADO21026
auggagguggugagccugaucaccauccugcugcuggugaccgugagcaacgccgacaagaucugcaucggcuaccagagcaccaacagcaccgagaccguggacacccugaccgagaacaacgugcccguggcccacgccaaggagcugcugcacaccgagcacaacggcaugcugugcgccaccaaccugggccacccccugauccuggacaccugcaccaucgagggccugaucuacggcaaccccagcugcgaccugcugcugggcggcagagaguggagcuacaucguggagagacccagcgccgugaacggccugugcuaccccggcaacguggagaaccuggaggagcugagaagccuguucagcagcgccagcagcuaccagagaauccagaucuuccccggcaccaucuggaacgugagcuacggcggcaccagcaaggccugcagcgacagcuucuacaagagcaugagauggcugacccagaagaacaacgccuaccccauccaggacgcccaguacaccaacaacagaggcaagaacauccuguucauguggggcaucaaccacccccccaccgacaccacccagaccaaccuguacaccagaaccgacaccaccaccagcguggccaccgaggacaucaacagaaccuucaacccccugaucggccccagaccccuggugaacggccagcagggcagaaucgacuacuacuggagcgugcugaagcccggccagacccugagagugagaagcaacggcaaccugaucgcccccugguacggccacauccugagcggcgagagccacggcagaauccugaagaccgaccugaacagcggcaacugcguggugcagugccagaccgagagaggcggccugaacaccacccugcccuuccacaacgugagcaaguacgccuucggcaacugccccaaguacgugggcgugaagagccugaagcuggccgugggccugagaaacgugcccgccagaagcagcagaggccuguucggcgccaucgccggcuucaucgagggcggcuggagcggccugguggccggcugguacggcuuccagcacagcaacgaccagggcgugggcauggccgccgacagagacagcacccagaaggccaucgacaagaucaccagcaaggugaacaacaucguggacaagaugaacaagcaguacgagaucaucgaccacgaguucagcgagguggagaccagacugaacaucaucaacaacaagaucgacgaccagauccaggacaucugggccuacaacgccgagcugcuggugcugcuggagaaccagaagacccuggacgagcacgacgccaacgugaacaaccuguacaacaaggugaagagagcccugggcagcaacgccguggaggacggcaagggcugcuucgagcuguaccacaagugcgacgaccagugcauggagaccaucagaaacggcaccuacaacagaagaaaguacaaggaggagagcagacuggagagacagaagaucgagggcgugaagcuggagagcgagggcaccuacaagauccugaccaucuacagcaccguggccagcagccuggugaucgccaugggcuucgccgccuuccuguucugggccaugagcaacggcagcugcagaugcaacaucugcaucuga

SEQ ID NO: 158640 - RNA, 1683 nt, Artificial Sequence
  derived and/or modified sequence opt4 from hemagglutinin__InfluenzaA__ADO21037
auggagguggugagccugaucaccauccugcugcuggugaccgugagcaacgccgacaagaucugcaucggcuaccagagcaccaacagcaccgagaccguggacacccugaccgagaacaacgugcccguggcccacgccaaggagcugcugcacaccgagcacaacggcaugcugugcgccaccaaccugggccacccccugauccuggacaccugcaccaucgagggccugaucuacggcaaccccagcugcgaccugcugcugggcggcagagaguggagcuacaucguggagagacccagcgccgugaacggccugugcuaccccggcaacguggagaaccuggaggagcugagaagccuguucagcagcgccagcagcuaccagagaauccagaucuuccccggcaccaucuggaacgugagcuacggcggcaccagcaaggccugcagcgacagcuucuacaagagcaugagauggcugacccagaagaacaacgccuaccccauccaggacgcccaguacaccaacaacagaggcaagaacauccuguucauguggggcaucaaccacccccccaccgacaccacccagaccaaccuguacaccagaaccgacaccaccaccagcguggccaccgaggacaucaacagaaccuucaagcccuacaucggccccagaccccuggugaacggccagcagggcagaaucgacuacuacuggagcgugcugaagcccggccagacccugagagugagaagcaacggcaaccugaucgcccccugguacggccacauccugagcggcgagagccacggcagaauccugaagaccgaccugaacagcggcaacugcguggugcagugccagaccgagagaggcggccugaacaccacccugcccuuccacaacgugagcaaguacgccuucggcaacugccccaaguacgugggcgugaagagccugaagcuggccgugggccugagaaacgugcccgccagaagcagcagaggccuguucggcgccaucgccggcuucaucgagggcggcuggagcggccugguggccggcugguacggcuuccagcacagcaacgaccagggcgugggcauggccgccgacagagaccugacccagaaggccaucgacaagaucaccagcaaggugaacaacaucguggacaagaugaacaagcaguacgagaucaucgaccacgaguucagcgagguggagaccagacugaacaugaucaacaacaagaucgacgaccagauccaggacaucugggccuacaacgccgagcugcuggugcugcuggagaaccagaagacccuggacgagcacgacgccaacgugaacaaccuguacaacaaggugaagagagcccugggcagcaacgccguggaggacggcaagggcugcuucgagcuguaccacaagugcgacgaccagugcauggagaccaucagaaacggcaccuacaacagaagaaaguacaaggaggagagcagacuggagagacagaagaucgagggcgugaagcuggagagcgagggcaccuacaagauccugaccaucuacagcaccguggccagcagccuggugaucgccaugggcuucgccgccuuccuguucugggccaugagcaacggcagcugcagaugcaacaucugcaucuga

SEQ ID NO: 158641 - RNA, 1683 nt, Artificial Sequence
  derived and/or modified sequence opt4 from hemagglutinin__InfluenzaA__ADO21048
auggagguggugagccugaucaccauccugcugcuggugaccgugagcaacgccgacaagaucugcaucggcuaccagagcaccaacagcaccgagaccguggacacccugaccgagaacaacgugcccguggcccacgccaaggagcugcugcacaccgagcacaacggcaugcugugcgccaccaaccugggccacccccugauccuggacaccugcaccaucgagggccugaucuacggcaaccccagcugcgaccugcugcugggcggcagagaguggagcuacaucguggagagacccagcgccgugaacggccugugcuaccccggcaacguggagaaccuggaggagcugagaagccuguucagcagcgccagcagcuaccagagaauccagaucuuccccggcaccaucuggaacgugagcuacggcggcaccagcaaggccugcagcgacagcuucuacaagagcaugagauggcugacccagaagaacaacgccuaccccauccaggacgcccaguacaccaacaacagaggcaagaacauccacuucauguggggcaucaaccacccccccaccgacaccacccagaccaaccuguacaccagaaccgacaccaccaccagcguggccaccgaggacaucaacagaaccuucaagccccugaucggccccagaccccuggugaacggccagcagggcagaaucgacuacuacuggagcgugcugaagcccggccagacccugagagugagaagcaacggcaaccugaucgcccccugguacggccacauccugagcggcgagagccacggcagaauccugaagaccgaccugaacagcggcaacugcguggugcagugccagaccgagagaggcggccugaacaccacccugcccuuccacaacgugagcaaguacgccuucggcaacugccccaaguacgugggcgugaagagccugaagcuggccgugggccugagaaacgugcccgccagaagcagcagaggccuguucggcgccaucgccggcuucaucgagggcggcuggagcggccugguggccggcugguacggcuuccagcacagcaacgaccagggcgugggcauggccgccgacagagugagcacccagaaggccaucgacaagaucaccagcaaggugaacaacaucguggacaagaugaacaagcaguacgagaucaucgaccacgaguucagcgagguggagaccagacugaacaugaucaacaacaagaucgacgaccagauccaggacaucugggccuacaacgccgagcugcuggugcugcuggagaaccagaagacccuggacgagcacgacgccaacgugaacaaccuguacaacaaggugaagagagcccugggcagcaacgccguggaggacggcaagggcugcuucgagcuguaccacaagugcgacgaccagugcauggagaccaucagaaacggcaccuacaacagaagaaaguacaaggaggagagcagacuggagagacagaagaucgagggcgugaagcuggagagcgagggcaccuacaagauccugaccaucuacagcaccguggccagcagccuggugaucgccaugggcuucgccgccuuccuguucugggccaugagcaacggcagcugcagaugcaacaucugcaucuga

SEQ ID NO: 158642 - RNA, 1701 nt, Artificial Sequence
  derived and/or modified sequence opt4 from hemagglutinin__InfluenzaA__ADO25092
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaacagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgcccacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158643 - RNA, 1701 nt, Artificial Sequence; identical to SEQ ID NO: 157061
  derived and/or modified sequence opt4 from hemagglutinin__InfluenzaA__ADO25112

SEQ ID NO: 158644 - RNA, 1701 nt, Artificial Sequence; identical to SEQ ID NO: 157061
  derived and/or modified sequence opt4 from hemagglutinin__InfluenzaA__ADO25122

SEQ ID NO: 158645 - RNA, 1701 nt, Artificial Sequence
  derived and/or modified sequence opt4 from hemagglutinin__InfluenzaA__ADO25132
augaacgccauccugguggugcugcuguacaccuucgccaccgccaacgccgacacccugugcaucggcuaccacgccaacaacagcaccgacaccguggacacccugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcgacaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaagaucaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158646 - RNA, 1701 nt, Artificial Sequence; identical to SEQ ID NO: 156802
  derived and/or modified sequence opt4 from hemagglutinin__InfluenzaA__ADO25142

SEQ ID NO: 158647 - RNA, 1701 nt, Artificial Sequence
  derived and/or modified sequence opt4 from hemagglutinin__InfluenzaA__ADO25152
augaaggccauccugguggugcugcuguacaccuucgccgccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagccuguucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158648 - RNA, 1701 nt, Artificial Sequence; identical to SEQ ID NO: 156741
  derived and/or modified sequence opt4 from hemagglutinin__InfluenzaA__ADO25162

SEQ ID NO: 158649 - RNA, 1701 nt, Artificial Sequence; identical to SEQ ID NO: 156741
  derived and/or modified sequence opt4 from hemagglutinin__InfluenzaA__ADO25172

SEQ ID NO: 158650 - RNA, 1701 nt, Artificial Sequence; identical to SEQ ID NO: 156741
  derived and/or modified sequence opt4 from hemagglutinin__InfluenzaA__ADO25182

SEQ ID NO: 158651 - RNA, 1701 nt, Artificial Sequence; identical to SEQ ID NO: 155189
  derived and/or modified sequence opt4 from hemagglutinin__InfluenzaA__ADO25192

SEQ ID NO: 158652 - RNA, 1701 nt, Artificial Sequence; identical to SEQ ID NO: 155189
  derived and/or modified sequence opt4 from hemagglutinin__InfluenzaA__ADO25202

SEQ ID NO: 158653 - RNA, 1701 nt, Artificial Sequence
  derived and/or modified sequence opt4 from hemagglutinin__InfluenzaA__ADO25212
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagagaaaggaggugcuggugcuguggggcauccaccaccccagcaccagcgccgaccagcagagccuguaccagaacgccgacagcuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158654 - RNA, 1701 nt, Artificial Sequence
  derived and/or modified sequence opt4 from hemagglutinin__InfluenzaA__ADO25222
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugaacaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158655 - RNA, 1701 nt, Artificial Sequence; identical to SEQ ID NO: 156802
  derived and/or modified sequence opt4 from hemagglutinin__InfluenzaA__ADO25232

SEQ ID NO: 158656 - RNA, 1701 nt, Artificial Sequence; identical to SEQ ID NO: 156741
  derived and/or modified sequence opt4 from hemagglutinin__InfluenzaA__ADO25242

SEQ ID NO: 158657 - RNA, 1701 nt, Artificial Sequence; identical to SEQ ID NO: 156819
  derived and/or modified sequence opt4 from hemagglutinin__InfluenzaA__ADO25252

SEQ ID NO: 158658 - RNA, 1701 nt, Artificial Sequence; identical to SEQ ID NO: 157061
  derived and/or modified sequence opt4 from hemagglutinin__InfluenzaA__ADO25262

SEQ ID NO: 158659 - RNA, 1701 nt, Artificial Sequence
  derived and/or modified sequence opt4 from hemagglutinin__InfluenzaA__ADO25272
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagauguuccccaagaccagcagcuggcccaaccacgacagcaacaagggcgugaccgccgccugcccccacgccggcgugaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158660 - RNA, 1701 nt, Artificial Sequence; identical to SEQ ID NO: 156802
  derived and/or modified sequence opt4 from hemagglutinin__InfluenzaA__ADO25282

SEQ ID NO: 158661 - RNA, 1698 nt, Artificial Sequence; identical to SEQ ID NO: 155008
  derived and/or modified sequence opt4 from hemagglutinin__InfluenzaA__ADO27622

SEQ ID NO: 158662 - RNA, 1701 nt, Artificial Sequence; identical to SEQ ID NO: 155189
  derived and/or modified sequence opt4 from hemagglutinin__InfluenzaA__ADO29887

SEQ ID NO: 158663 - RNA, 1701 nt, Artificial Sequence
  derived and/or modified sequence opt4 from hemagglutinin__InfluenzaA__ADO29888
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcagacugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgaccccaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158664 - RNA, 1701 nt, Artificial Sequence
  derived and/or modified sequence opt4 from hemagglutinin__InfluenzaA__ADO29889
augaaggccauccugguggugcugcuguacaccuucgccaccgccaacgccgacauccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagcuucagcaccagcagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158665 - RNA, 1701 nt, Artificial Sequence
  derived and/or modified sequence opt4 from hemagglutinin__InfluenzaA__ADO29890
augaaggccauccugguggugcugcuguacaccuucgccaccgccaaggccgacacccugugcaucggcuaccacgccaacaacagcgccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgaccccaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcguggaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158666 - RNA, 1701 nt, Artificial Sequence
  derived and/or modified sequence opt4 from hemagglutinin__InfluenzaA__ADO29891
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaccaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugagcgagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158667 - RNA, 1701 nt, Artificial Sequence
  derived and/or modified sequence opt4 from hemagglutinin__InfluenzaA__ADO29892
augaaggccauccugguggugcugcuguacaccuucgccaccgccaaggccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcagaauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgaccccaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcguggaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158668 - RNA, 1701 nt, Artificial Sequence; identical to SEQ ID NO: 155987
  derived and/or modified sequence opt4 from hemagglutinin__InfluenzaA__ADO29893

SEQ ID NO: 158669 - RNA, 1701 nt, Artificial Sequence
  derived and/or modified sequence opt4 from hemagglutinin__InfluenzaA__ADO29894
augaaggccauccugguggugcugcuguacaccuucgccaccgccaacgccgacacccugugcaucggcuaccacgccaacaacagcaccgacaccguggacaccgugcuggagaugaacgugaccgugacccacagcgugaaccugcuggaggacaagcacaacggcaagcugugcaagcugagaggcguggccccccugcaccugggcaagugcaacaucgccggcuggauccugggcaaccccgagugcgagagcuucagcaccagcagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcagcagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158670 - RNA, 1701 nt, Artificial Sequence
  derived and/or modified sequence opt4 from hemagglutinin__InfluenzaA__ADO29895
augaaggccauccugguggcccugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagcuucagcaccagcagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcagcagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagggcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagagugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158671 - RNA, 1701 nt, Artificial Sequence
  derived and/or modified sequence opt4 from hemagglutinin__InfluenzaA__ADO29897
augaaggccauccugguggugcugcuguacaccuucgccaccgccaacgccgacauccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagcuucagcaccagcagcagcuggagcuacaucguggagaccagcagcagcgacaacggcaagugcuaccccggcgacuucaucgacuacgaggagcugagagagcagcugagcagcgugagcagcuucgagagauucgagaucuuccccaagaccagcagcuggcccaaccacgacagcaacaagggcgugaccaccgccugcccccacgccggcgccaagagcuucuacaagaaccugaucuggcuggugaagaagggcaacagcuaccccagacugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacggcugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccguggccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158672 - RNA, 1701 nt, Artificial Sequence; identical to SEQ ID NO: 155987
  derived and/or modified sequence opt4 from hemagglutinin__InfluenzaA__ADO29898

SEQ ID NO: 158673 - RNA, 1701 nt, Artificial Sequence
  derived and/or modified sequence opt4 from hemagglutinin__InfluenzaA__ADO29899
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaccugcaucuga

SEQ ID NO: 158674 - RNA, 1701 nt, Artificial Sequence
  derived and/or modified sequence opt4 from hemagglutinin__InfluenzaA__ADO29900
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgaccugaucgacuacgaggagcugagagagcagcugagcagcgugagcagcuucgagagauucgagaucuuccccaagaccagcagcuggcccaaccacgaccugaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaagagcaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugagaagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucugggccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158675 - RNA, 1701 nt, Artificial Sequence
  derived and/or modified sequence opt4 from hemagglutinin__InfluenzaA__ADO29901
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacgagaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggccaagaagggcaacagcuaccccaaggugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcuucaacggcagccugcagugcagaaucugcaucuga

SEQ ID NO: 158676 - RNA, 1701 nt, Artificial Sequence
  derived and/or modified sequence opt4 from hemagglutinin__InfluenzaA__ADO29902
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagggcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158677 - RNA, 1701 nt, Artificial Sequence
  derived and/or modified sequence opt4 from hemagglutinin__InfluenzaA__ADO29903
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaccgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgaccccaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158678 - RNA, 1701 nt, Artificial Sequence
  derived and/or modified sequence opt4 from hemagglutinin__InfluenzaA__ADO29904
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcagaugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgaccccaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccacagacccagcaccagcgccgaccagcagagccuguaccagaacgccgacgccuacguguucgugggcaccagcagauacagcaagaaguucaagcccgagaucgccaucagacccaaggugggcgaccaggagggcagaaugaacuacuacuggacccugguggagcccggcgacaagaucaccuucgaggccaccggcaaccugguggugcccagauacgccuucgccauggagagaaacgccggcagcggcaucaucaucagcaacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158679 - RNA, 1701 nt, Artificial Sequence
  derived and/or modified sequence opt4 from hemagglutinin__InfluenzaA__ADO29905
augaaggccauccugguggugcugcuguacaccuucgccaccgccaacgccgacacccugugcaucggcuaccacgccaacaacagcaccgacaccguggacaccgugcuggagaagaacgugaccgugaccagaagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgaccccaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcaacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158680 - RNA, 1701 nt, Artificial Sequence
  derived and/or modified sequence opt4 from hemagglutinin__InfluenzaA__ADO29906
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacagaaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgaccccaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158681 - RNA, 1701 nt, Artificial Sequence
  derived and/or modified sequence opt4 from hemagglutinin__InfluenzaA__ADO29907
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgaccccaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaagcugaagcccgagaucgccaucagacccaaggugagagaccaggagggcagaaugaacuaccacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158682 - RNA, 1701 nt, Artificial Sequence
  derived and/or modified sequence opt4 from hemagglutinin__InfluenzaA__ADO29908
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgaccccaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggaguggagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaguguaccagauccuggccaccuacagcaccguggccagcagccuggugcugguggugagccugggcgccaucagcuucuggaugugcagcaacggcagccugcagugcagaaucugcaucuga

SEQ ID NO: 158683 - RNA, 1701 nt, Artificial Sequence
  derived and/or modified sequence opt4 from hemagglutinin__InfluenzaA__ADO29909
augaaggccauccugguggugcugcuguacaccuucgccaccgccaacgccgacacccugagaaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgaccccaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcauccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccugauccugguggugagccugggcgccaucagcuucuggaugugcagcaacggcagccugcagugcagaaucugcaucuga

SEQ ID NO: 158684 - RNA, 1701 nt, Artificial Sequence
  derived and/or modified sequence opt4 from hemagglutinin__InfluenzaA__ADO29910
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcccagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgaccccaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaucggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagaggcgagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158685 - RNA, 1701 nt, Artificial Sequence; identical to SEQ ID NO: 156911
  derived and/or modified sequence opt4 from hemagglutinin__InfluenzaA__ADO30407

SEQ ID NO: 158686 - RNA, 1701 nt, Artificial Sequence; identical to SEQ ID NO: 156802
  derived and/or modified sequence opt4 from hemagglutinin__InfluenzaA__ADO30417

SEQ ID NO: 158687 - RNA, 1701 nt, Artificial Sequence; identical to SEQ ID NO: 156524
  derived and/or modified sequence opt4 from hemagglutinin__InfluenzaA__ADO33202

SEQ ID NO: 158688 - RNA, 1701 nt, Artificial Sequence; identical to SEQ ID NO: 156032
  derived and/or modified sequence opt4 from hemagglutinin__InfluenzaA__ADO33240

SEQ ID NO: 158689 - RNA, 1701 nt, Artificial Sequence; identical to SEQ ID NO: 155189
  derived and/or modified sequence opt4 from hemagglutinin__InfluenzaA__ADO33247

SEQ ID NO: 158690 - RNA, 1701 nt, Artificial Sequence; identical to SEQ ID NO: 156032
  derived and/or modified sequence opt4 from hemagglutinin__InfluenzaA__ADO33254

SEQ ID NO: 158691 - RNA, 1701 nt, Artificial Sequence; identical to SEQ ID NO: 156032
  derived and/or modified sequence opt4 from hemagglutinin__InfluenzaA__ADO33261

SEQ ID NO: 158692 - RNA, 1701 nt, Artificial Sequence; identical to SEQ ID NO: 156032
  derived and/or modified sequence opt4 from hemagglutinin__InfluenzaA__ADO33269

SEQ ID NO: 158693 - RNA, 1701 nt, Artificial Sequence; identical to SEQ ID NO: 156524
  derived and/or modified sequence opt4 from hemagglutinin__InfluenzaA__ADO33277

SEQ ID NO: 158694 - RNA, 1701 nt, Artificial Sequence; identical to SEQ ID NO: 156032
  derived and/or modified sequence opt4 from hemagglutinin__InfluenzaA__ADO33285

SEQ ID NO: 158695 - RNA, 1701 nt, Artificial Sequence; identical to SEQ ID NO: 156524
  derived and/or modified sequence opt4 from hemagglutinin__InfluenzaA__ADO33293

SEQ ID NO: 158696 - RNA, 1701 nt, Artificial Sequence; identical to SEQ ID NO: 156524
  derived and/or modified sequence opt4 from hemagglutinin__InfluenzaA__ADO33307

SEQ ID NO: 158697 - RNA, 1701 nt, Artificial Sequence; identical to SEQ ID NO: 156032
  derived and/or modified sequence opt4 from hemagglutinin__InfluenzaA__ADO33313

SEQ ID NO: 158698 - RNA, 1701 nt, Artificial Sequence; identical to SEQ ID NO: 158282
  derived and/or modified sequence opt4 from hemagglutinin__InfluenzaA__ADO33329

SEQ ID NO: 158699 - RNA, 1701 nt, Artificial Sequence; identical to SEQ ID NO: 156032
  derived and/or modified sequence opt4 from hemagglutinin__InfluenzaA__ADO33337

SEQ ID NO: 158700 - RNA, 1701 nt, Artificial Sequence; identical to SEQ ID NO: 156032
  derived and/or modified sequence opt4 from hemagglutinin__InfluenzaA__ADO33345

SEQ ID NO: 158701 - RNA, 1701 nt, Artificial Sequence; identical to SEQ ID NO: 156524
  derived and/or modified sequence opt4 from hemagglutinin__InfluenzaA__ADO33352

SEQ ID NO: 158702 - RNA, 1701 nt, Artificial Sequence; identical to SEQ ID NO: 155189
  derived and/or modified sequence opt4 from hemagglutinin__InfluenzaA__ADO33360

SEQ ID NO: 158703 - RNA, 1701 nt, Artificial Sequence; identical to SEQ ID NO: 156032
  derived and/or modified sequence opt4 from hemagglutinin__InfluenzaA__ADO33368

SEQ ID NO: 158704 - RNA, 1701 nt, Artificial Sequence; identical to SEQ ID NO: 156032
  derived and/or modified sequence opt4 from hemagglutinin__InfluenzaA__ADO33376

SEQ ID NO: 158705 - RNA, 1701 nt, Artificial Sequence; identical to SEQ ID NO: 155176
  derived and/or modified sequence opt4 from hemagglutinin__InfluenzaA__ADO33384

SEQ ID NO: 158706 - RNA, 1701 nt, Artificial Sequence; identical to SEQ ID NO: 155189
  derived and/or modified sequence opt4 from hemagglutinin__InfluenzaA__ADO33391

SEQ ID NO: 158707 - RNA, 1701 nt, Artificial Sequence
  derived and/or modified sequence opt4 from hemagglutinin__InfluenzaA__ADO79917
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagacagagagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacaacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158708 - RNA, 1701 nt, Artificial Sequence
  derived and/or modified sequence opt4 from hemagglutinin__InfluenzaA__ADO79923
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcaccgacaaguggaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagagaagaaugaacuacuacuggacccuggugcagcccggcgacaagaucaccuuccaggccaccggcaaccugguggugcccagauacgccuucgccauggagagaaacgccggcagcggcaucaucaucagcgacacccccgugcacaacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158709 - RNA, 1701 nt, Artificial Sequence
  derived and/or modified sequence opt4 from hemagglutinin__InfluenzaA__ADO79924
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcaccgacaaguggaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagacagagagggcagaaugaacuacuacuggacccugaucgagcccggcgacaagaucaccuucgagcccaccggcaaccugguggugcccagauacgccuucgccauggagagaaacgccggcagcggcaucaucaucagcgacacccccgugcacaacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158710 - RNA, 1701 nt, Artificial Sequence
  derived and/or modified sequence opt4 from hemagglutinin__InfluenzaA__ADO79925
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcacccacgaguggaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagacagagagggcagaaugaacuacuacuggacccugguggagcccggcgacaagaucaccuucgaggcccccggcaaccugguggugcccagauacgccuucgccauggagagaaacgccggcagcggcaucaucaucagcgacacccccgugcacaacugcaacaccaccugccagacccccaagggcgccaucaacaccagccugcccuuccagaacauccaccccaucaagaucggcaagugcagcaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158711 - RNA, 1701 nt, Artificial Sequence
  derived and/or modified sequence opt4 from hemagglutinin__InfluenzaA__ADO79926
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcaccgacaaguggaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuucagcaagcugagcaagaccuaccugaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgugggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaugaagaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158712 - RNA, 1701 nt, Artificial Sequence
  derived and/or modified sequence opt4 from hemagglutinin__InfluenzaA__ADO79927
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcaccgacaaguggaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccgccgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcgugcagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaugaagaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158713 - RNA, 1701 nt, Artificial Sequence
  derived and/or modified sequence opt4 from hemagglutinin__InfluenzaA__ADO79928
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcaccgacaaguggaccugcuaccccggcgacuucaucgacuacgaggagcugagagagcagcugagcagcgugagcagcuucgagagauucgagaucuuccccaagaccaacagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcaaguacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158714 - RNA, 1701 nt, Artificial Sequence
  derived and/or modified sequence opt4 from hemagglutinin__InfluenzaA__ADO79929
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcaccgacaaguggaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagaggccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158715 - RNA, 1701 nt, Artificial Sequence
  derived and/or modified sequence opt4 from hemagglutinin__InfluenzaA__ADO79930
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcaccgacaaguggaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagacagagagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacaacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158716 - RNA, 1701 nt, Artificial Sequence
  derived and/or modified sequence opt4 from hemagglutinin__InfluenzaA__ADO84715
augaaggccauccugguggugcugcuguacaccuucgccaccgccaacgccggcacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccuucagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158717 - RNA, 1701 nt, Artificial Sequence; identical to SEQ ID NO: 155369
  derived and/or modified sequence opt4 from hemagglutinin__InfluenzaA__ADP95341

SEQ ID NO: 158718 - RNA, 1701 nt, Artificial Sequence; identical to SEQ ID NO: 155176
  derived and/or modified sequence opt4 from hemagglutinin__InfluenzaA__ADP95351

SEQ ID NO: 158719 - RNA, 1701 nt, Artificial Sequence; identical to SEQ ID NO: 155176
  derived and/or modified sequence opt4 from hemagglutinin__InfluenzaA__ADP95361

SEQ ID NO: 158720 - RNA, 1701 nt, Artificial Sequence; identical to SEQ ID NO: 155176
  derived and/or modified sequence opt4 from hemagglutinin__InfluenzaA__ADP95371

SEQ ID NO: 158721 - RNA, 1701 nt, Artificial Sequence; identical to SEQ ID NO: 155176
  derived and/or modified sequence opt4 from hemagglutinin__InfluenzaA__ADP95381

SEQ ID NO: 158722 - RNA, 1701 nt, Artificial Sequence; identical to SEQ ID NO: 155176
  derived and/or modified sequence opt4 from hemagglutinin__InfluenzaA__ADP95391

SEQ ID NO: 158723 - RNA, 1701 nt, Artificial Sequence; identical to SEQ ID NO: 155431
  derived and/or modified sequence opt4 from hemagglutinin__InfluenzaA__ADQ28007

SEQ ID NO: 158724 - RNA, 1701 nt, Artificial Sequence; identical to SEQ ID NO: 155189
  derived and/or modified sequence opt4 from hemagglutinin__InfluenzaA__ADQ28008

SEQ ID NO: 158725 - RNA, 1701 nt, Artificial Sequence; identical to SEQ ID NO: 157040
  derived and/or modified sequence opt4 from hemagglutinin__InfluenzaA__ADQ28009

SEQ ID NO: 158726 - RNA, 1701 nt, Artificial Sequence
  derived and/or modified sequence opt4 from hemagglutinin__InfluenzaA__ADQ28010
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagagccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158727 - RNA, 1701 nt, Artificial Sequence; identical to SEQ ID NO: 155189
  derived and/or modified sequence opt4 from hemagglutinin__InfluenzaA__ADQ28011

SEQ ID NO: 158728 - RNA, 1701 nt, Artificial Sequence; identical to SEQ ID NO: 155189
  derived and/or modified sequence opt4 from hemagglutinin__InfluenzaA__ADQ28012

SEQ ID NO: 158729 - RNA, 1701 nt, Artificial Sequence; identical to SEQ ID NO: 155189
  derived and/or modified sequence opt4 from hemagglutinin__InfluenzaA__ADQ28013

SEQ ID NO: 158730 - RNA, 1701 nt, Artificial Sequence; identical to SEQ ID NO: 155431
  derived and/or modified sequence opt4 from hemagglutinin__InfluenzaA__ADQ28014

SEQ ID NO: 158731 - RNA, 1701 nt, Artificial Sequence; identical to SEQ ID NO: 155431
  derived and/or modified sequence opt4 from hemagglutinin__InfluenzaA__ADQ28015

SEQ ID NO: 158732 - RNA, 1701 nt, Artificial Sequence; identical to SEQ ID NO: 155189
  derived and/or modified sequence opt4 from hemagglutinin__InfluenzaA__ADQ28016

SEQ ID NO: 158733 - RNA, 1701 nt, Artificial Sequence; identical to SEQ ID NO: 155189
  derived and/or modified sequence opt4 from hemagglutinin__InfluenzaA__ADQ28017

SEQ ID NO: 158734 - RNA, 1701 nt, Artificial Sequence; identical to SEQ ID NO: 157435
  derived and/or modified sequence opt4 from hemagglutinin__InfluenzaA__ADQ28018

SEQ ID NO: 158735 - RNA, 1701 nt, Artificial Sequence; identical to SEQ ID NO: 155431
  derived and/or modified sequence opt4 from hemagglutinin__InfluenzaA__ADQ28019

SEQ ID NO: 158736 - RNA, 1701 nt, Artificial Sequence
  derived and/or modified sequence opt4 from hemagglutinin__InfluenzaA__ADQ28020
auggaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccaggccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccacaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158737 - RNA, 1701 nt, Artificial Sequence; identical to SEQ ID NO: 156383
  derived and/or modified sequence opt4 from hemagglutinin__InfluenzaA__ADQ28021

SEQ ID NO: 158738 - RNA, 1701 nt, Artificial Sequence
  derived and/or modified sequence opt4 from hemagglutinin__InfluenzaA__ADQ28022
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcaacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagaggccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158739 - RNA, 1701 nt, Artificial Sequence; identical to SEQ ID NO: 155189
  derived and/or modified sequence opt4 from hemagglutinin__InfluenzaA__ADQ28023

SEQ ID NO: 158740 - RNA, 1701 nt, Artificial Sequence; identical to SEQ ID NO: 155431
  derived and/or modified sequence opt4 from hemagglutinin__InfluenzaA__ADQ28024

SEQ ID NO: 158741 - RNA, 1701 nt, Artificial Sequence; identical to SEQ ID NO: 155431
  derived and/or modified sequence opt4 from hemagglutinin__InfluenzaA__ADQ28025

SEQ ID NO: 158742 - RNA, 1701 nt, Artificial Sequence; identical to SEQ ID NO: 155934
  derived and/or modified sequence opt4 from hemagglutinin__InfluenzaA__ADQ28028

SEQ ID NO: 158743 - RNA, 1701 nt, Artificial Sequence; identical to SEQ ID NO: 157414
  derived and/or modified sequence opt4 from hemagglutinin__InfluenzaA__ADQ28029

SEQ ID NO: 158744 - RNA, 1701 nt, Artificial Sequence
  derived and/or modified sequence opt4 from hemagglutinin__InfluenzaA__ADQ28030
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcaucaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158745 - RNA, 1701 nt, Artificial Sequence; identical to SEQ ID NO: 156383
  derived and/or modified sequence opt4 from hemagglutinin__InfluenzaA__ADQ28031

SEQ ID NO: 158746 - RNA, 1701 nt, Artificial Sequence; identical to SEQ ID NO: 155431
  derived and/or modified sequence opt4 from hemagglutinin__InfluenzaA__ADQ28032

SEQ ID NO: 158747 - RNA, 1701 nt, Artificial Sequence
  derived and/or modified sequence opt4 from hemagglutinin__InfluenzaA__ADQ28034
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagaggccaggagggcagaaugaacuacuacuggaccaucguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacagaaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158748 - RNA, 1701 nt, Artificial Sequence
  derived and/or modified sequence opt4 from hemagglutinin__InfluenzaA__ADQ28035
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcagacugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagaggccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158749 - RNA, 1701 nt, Artificial Sequence; identical to SEQ ID NO: 155189
  derived and/or modified sequence opt4 from hemagglutinin__InfluenzaA__ADQ28036

SEQ ID NO: 158750 - RNA, 1701 nt, Artificial Sequence; identical to SEQ ID NO: 155189
  derived and/or modified sequence opt4 from hemagglutinin__InfluenzaA__ADQ28037

SEQ ID NO: 158751 - RNA, 1701 nt, Artificial Sequence; identical to SEQ ID NO: 155431
  derived and/or modified sequence opt4 from hemagglutinin__InfluenzaA__ADQ28038

SEQ ID NO: 158752 - RNA, 1701 nt, Artificial Sequence; identical to SEQ ID NO: 155189
  derived and/or modified sequence opt4 from hemagglutinin__InfluenzaA__ADQ28039

SEQ ID NO: 158753 - RNA, 1701 nt, Artificial Sequence; identical to SEQ ID NO: 155431
  derived and/or modified sequence opt4 from hemagglutinin__InfluenzaA__ADQ28040

SEQ ID NO: 158754 - RNA, 1701 nt, Artificial Sequence; identical to SEQ ID NO: 155431
  derived and/or modified sequence opt4 from hemagglutinin__InfluenzaA__ADQ28041

SEQ ID NO: 158755 - RNA, 1701 nt, Artificial Sequence
  derived and/or modified sequence opt4 from hemagglutinin__InfluenzaA__ADQ28043
auggaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgacggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccacaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158756 - RNA, 1701 nt, Artificial Sequence; identical to SEQ ID NO: 155431
  derived and/or modified sequence opt4 from hemagglutinin__InfluenzaA__ADQ28044

SEQ ID NO: 158757 - RNA, 1701 nt, Artificial Sequence
  derived and/or modified sequence opt4 from hemagglutinin__InfluenzaA__ADQ28045
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcagccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158758 - RNA, 1701 nt, Artificial Sequence; identical to SEQ ID NO: 155659
  derived and/or modified sequence opt4 from hemagglutinin__InfluenzaA__ADQ28047

SEQ ID NO: 158759 - RNA, 1701 nt, Artificial Sequence; identical to SEQ ID NO: 155189
  derived and/or modified sequence opt4 from hemagglutinin__InfluenzaA__ADQ28048

SEQ ID NO: 158760 - RNA, 1701 nt, Artificial Sequence; identical to SEQ ID NO: 155431
  derived and/or modified sequence opt4 from hemagglutinin__InfluenzaA__ADQ28049

SEQ ID NO: 158761 - RNA, 1701 nt, Artificial Sequence; identical to SEQ ID NO: 155189
  derived and/or modified sequence opt4 from hemagglutinin__InfluenzaA__ADQ28050

SEQ ID NO: 158762 - RNA, 1701 nt, Artificial Sequence
  derived and/or modified sequence opt4 from hemagglutinin__InfluenzaA__ADQ28051
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacgacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158763 - RNA, 1701 nt, Artificial Sequence; identical to SEQ ID NO: 155189
  derived and/or modified sequence opt4 from hemagglutinin__InfluenzaA__ADQ28053

SEQ ID NO: 158764 - RNA, 1701 nt, Artificial Sequence; identical to SEQ ID NO: 155431
  derived and/or modified sequence opt4 from hemagglutinin__InfluenzaA__ADQ28055

SEQ ID NO: 158765 - RNA, 1701 nt, Artificial Sequence
  derived and/or modified sequence opt4 from hemagglutinin__InfluenzaA__ADQ28056
auggaggccauccugguggugcugcuguacaccuucgccaccgccgacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccacaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158766 - RNA, 1701 nt, Artificial Sequence; identical to SEQ ID NO: 155189
  derived and/or modified sequence opt4 from hemagglutinin__InfluenzaA__ADQ28057

SEQ ID NO: 158767 - RNA, 1701 nt, Artificial Sequence; identical to SEQ ID NO: 155189
  derived and/or modified sequence opt4 from hemagglutinin__InfluenzaA__ADQ28058

SEQ ID NO: 158768 - RNA, 1701 nt, Artificial Sequence
  derived and/or modified sequence opt4 from hemagglutinin__InfluenzaA__ADQ28059
augaaggccauccugguggugcugcuguacacccuggccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcaaguacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158769 - RNA, 1701 nt, Artificial Sequence; identical to SEQ ID NO: 155189
  derived and/or modified sequence opt4 from hemagglutinin__InfluenzaA__ADQ28060

SEQ ID NO: 158770 - RNA, 1701 nt, Artificial Sequence
  derived and/or modified sequence opt4 from hemagglutinin__InfluenzaA__ADQ28061
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcagaugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccaacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158771 - RNA, 1701 nt, Artificial Sequence
  derived and/or modified sequence opt4 from hemagglutinin__InfluenzaA__ADQ28063
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagaaaccaggagggcagaaugaacuaccacuggacccuggugaagcccggcgacaagaucaccuucgaggccaccggcaaccugguggugcccagauacgccuucgccguggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158772 - RNA, 1701 nt, Artificial Sequence; identical to SEQ ID NO: 155937
  derived and/or modified sequence opt4 from hemagglutinin__InfluenzaA__ADQ28064

SEQ ID NO: 158773 - RNA, 1701 nt, Artificial Sequence
  derived and/or modified sequence opt4 from hemagglutinin__InfluenzaA__ADQ28065
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccggccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccaggugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158774 - RNA, 1701 nt, Artificial Sequence
  derived and/or modified sequence opt4 from hemagglutinin__InfluenzaA__ADQ28066
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccagagugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158775 - RNA, 1701 nt, Artificial Sequence
  derived and/or modified sequence opt4 from hemagglutinin__InfluenzaA__ADQ28067
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucaacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158776 - RNA, 1701 nt, Artificial Sequence
  derived and/or modified sequence opt4 from hemagglutinin__InfluenzaA__ADQ28068
augaaggccauccugguggugcugcuguacaccuucaccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgagaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuaccacuggacccuggugaagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158777 - RNA, 1701 nt, Artificial Sequence; identical to SEQ ID NO: 158775
  derived and/or modified sequence opt4 from hemagglutinin__InfluenzaA__ADQ28069

SEQ ID NO: 158778 - RNA, 1701 nt, Artificial Sequence
  derived and/or modified sequence opt4 from hemagglutinin__InfluenzaA__ADQ28070
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagacagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158779 - RNA, 1701 nt, Artificial Sequence
  derived and/or modified sequence opt4 from hemagglutinin__InfluenzaA__ADQ28071
augaaggccauccugguggugcugcuguacacccuggccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158780 - RNA, 1701 nt, Artificial Sequence; identical to SEQ ID NO: 156133
  derived and/or modified sequence opt4 from hemagglutinin__InfluenzaA__ADR32361

SEQ ID NO: 158781 - RNA, 1689 nt, Artificial Sequence
  derived and/or modified sequence opt4 from hemagglutinin__InfluenzaA__ADT78887
auggcccugaucuaccugauccugcuguucaccagcgugagaggcgaccagaucugcaucggcuaccacgccaacaacagcaccgagaagguggacaccauccuggagagaaacgugaccgugacccacgccaaggacauccuggagaagacccacaacggcaagcugugcaagcugaacggcauccccccccuggagcugggcgacugcagcaucgccggcuggcugcugggcaaccccgagugcgacagacugcugagagugcccgaguggagcuacaucauggagaaggagaaccccaaguacagccugugcuaccccggcagcuucaacgacuacgaggagcugaagcaccugaucagcagcgugaagcacuucgagaaggugaagauccugcccaaggacggcuggacccagcacaccaccaccggcggcagcagagccugcgccgugagcggcaaccccagcuucuucagaaacaugguguggcugaccaagaagggccccaacuaccccguggccaagggcagcuacaacaacaccagcggcgagcagaugcugaucaucuggggcgugcaccaccccaacgacgaggccgagcagagagcccuguaccagaaggugggcaccuacgugagcgccagcaccagcacccugaacaagagaagcacccccgagaucgccgccagacccgaggugaacggccugggcagcagaauggaguucagcuggacccugcuggacaugugggacaccaucaacuucgagagcaccggcaaccugguggcccccgaguacggcuucaagaucagcaagagaggcagcagcggcgugaugaagaccgagggcacccuggagaacugcgagaccaagugccagaccccccugggcgccaucaacaccacccugcccuuccacaacgugcacccccugaccaucggcgagugccccaaguacgugaagagcgagaagcuggugcuggccaccggccugagaaacgugccccagaucgagagcagaggccuguucggcgccaucgccggcuucaucgagggcggcuggcagggcaugguggacggcugguacggcuaccaccacagcaacgaccagggcagcggcuacgccgccgacaaggagagcacccagaaggccuucgacggcaucaccaacaaggugaacagcgugaucgagaagaugaacacccaguucgaggccgugggcaaggaguucagcaaccuggagaagagacuggagaaccugaacaagaagauggaggacggcuuccuggacguguggaccuacaacgccgagcugcuggugcugauggagaacgagagaacccuggacuuccacgacagcaacgugaagaaccuguacgacaaggugagaaugcagcugagagacaacgugaaggagcugggcaacggcugcuucgaguucuaccacaagugcgacgacgagugcauggacagcgugaagaacggcaccuacgacuaccccaaguacgaggaggagagcaagcugaacagaaacgagaucaagggcgugaagcugagcagcaugggcguguaccagauccuggccaucuacgccaccguggccggcagccugagccuggccaucaugauggccggcaucagcuucuggaugugcagcaacggcagccugcagugcagaaucugcaucuga

SEQ ID NO: 158782 - RNA, 1701 nt, Artificial Sequence
  derived and/or modified sequence opt4 from hemagglutinin__InfluenzaA__ADT78908
augaaggccaagcugcugauccugcugugcgcccugagcgccaccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaaggccccccugcagcugggcaagugcaacaucgccggcugggugcugggcaaccccgagugcgagagccugcugagcaacagaagcuggagcuacaucgccgagacccccaacagcgagaacggcaccugcuaccccggcgacuucgccgacuacgaggagcugagagagcagcugagcagcgugagcagcuucgagagauucgagaucuuccccaaggagagaagcuggcccaagcacaacaccaccagaggcgugaccgccgccugcagccacgccagaaagagcagcuucuacaagaaccugguguggcugaccgaggccaacggcagcuaccccaaccugagcaagagcuacgugaacaaccaggagaaggaggugcuggugcuguggggcgugcaccaccccagcaacaucgaggaccagagaacccuguacagaaaggacaacgccuacgugagcguggugagcagcaacuacaacagaagauucacccccgagaucgccaagagacccaaggugagagaccagcccggcagaaugaacuacuacuggacccugcuggagcccggcgacaccaucaucuucgaggccaccggcaaccugaucgcccccugguacgccuucgcccugagcagaggccccggcagcggcaucaucaccagcaacgcccccauggacgagugcgacaccaagugccagaccccccagggcgccaucaacagcagccugcccuuccagaacauccaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugauggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagaaccagcugagaaacaacgccaaggagcugggcaacggcugcuucgaguucuaccacaagugcgacaacgagugcauggagagcgugaagaacggcaccuacgacuaccccaaguacagcgaggagagcaagcugaacagagagaagaucgacggcgugaagcuggagagcaugggcguguacagaauccuggccaucuacagcaccguggccagcagccuggugcugcuggugagccugggcgccaucagcuucuggaugugcagcaacggcagccugcagugcagaaucugcaucuga

SEQ ID NO: 158783 - RNA, 1701 nt, Artificial Sequence
  derived and/or modified sequence opt4 from hemagglutinin__InfluenzaA__ADT78929
augaaggccaagcugcugauccugcugugcgcccugagcgccaccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcaacaucgccggcuggauccugggcaaccccgagugcgagagccugcugagcaagagaagcuggagcuacaucgccgagacccccaacagcgagaacggcaccugcuaccccggcgacuucgccgacuacgaggagcugagagagcagcugagcagcgugagcagcuucgagagauucgagaucuuccccaaggagagaagcuggcccaagcacaacaucaccagaggcgugaccgccgccugcagccacgccggcaagagcagcuucuacaagaaccugcuguggcugaccgagaccaagggcagcuaccccaaccugagcaagagcuacgugaacaacaaggagaaggaggugcuggugcuguggggcgugcaccaccccagcaacaucgaggaccagaagacccuguacagaaaggagaacgccuacgugagcguggugagcagcaacuacaacagaagauucacccccgagaucgccgagagacccaaggugagaggccaggccggcagaaugaacuacuacuggacccugcuggagcccggcgacaccaucaucuucgaggccaacggcaaccugaucgcccccugguacgccuucgcccugagcagaggccugggcagcggcaucaucaccagcaacgccagcauggacgagugcgacaccaagugccagaccccccagggcgccaucaacagcagccugcccuuccagaacauccaccccgugaccaucggcgagugccccaaguacgugaagagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagaaccagcugagaaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 158784 - RNA, 1701 nt, Artificial Sequence
  derived and/or modified sequence opt4 from hemagglutinin__InfluenzaA__ADT78936
augaaggccaagcugcuggugcugcugugcgcccugagcgccaccuacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaaggccccccugcagcugggcaagugcaacaucgccggcuggauccugggcaaccccgagugcgagagccugcugagcaagagaagcuggagcuacaucgccgagacccccaacagcgagaacggcaccugcuaccccggcgacuucgccgacuacgaggagcugagagagcagcugagcagcgugagcagcuucgagagauucgagaucuuccccaaggagagcagcuggcccaagcacaacaccaccagaggcgugaccgccgccugcagccacgccagaaagagcagcuucuacaagaaccugcuguggcugaccgaggccaacggcagcuaccccaaccugagcaagagcuacgugaacaaccaggagaaggaggugcuggugcuguggggcgugcaccaccccagcaacaucgaggaccagagaacccuguacagaaaggagaacgccuacgugagcguggugagcagcaacuacaacagaagauucacccccgagaucgccgagagacccaaggugagaaaccaggccggcagaaugaacuacuacuggacccugcuggagcccggcgacaccaucaucuucgaggccaacggcaaccugaucgcccccugguacgccuucgcccugagcagaggccugggcagcggcaucaucaccagcaacgccagcauggacgagugcgacaccaagugccagaccccccagggcgccaucaacagcagccugcccuuccagaacauccaccccgugaccaucggcgagugccccaaguacgugaagagcaccaagcugagaauggugaccggccugagaaacauccccagcauccagagcagaggccuguucggcgccaucgccggcuucaucgagggcggcuggaccggcaugauggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagaaccagcugagaaacaacgccaaggagcugggcaacggcugcuucgaguucuaccacaagugcgacaacgagugcauggagagcgugaagaacggcaccuacgacuaccccaaguacagcgaggagagcaagcugaacagagagaagaucgacggcgugaagcuggagagcaugggcguguacagaauccuggccaucuacagcaccguggccagcagccuggugcugcuggugagccugggcgccaucagcuucuggaugugcagcaacggcagccugcagugcagaaucugcaucuga

SEQ ID NO: 158785 - RNA, 1689 nt, Artificial Sequence
  derived and/or modified sequence opt4 from hemagglutinin__InfluenzaA__ADT78961
auggccaucaucugccugauccugcuguucaccgccgugagaggcgaccagaucugcaucggcuaccacgccaacaacagcaccgagaagguggacaccauccuggagagaaacgugaccgugacccacgccaaggacauccuggagaagacccacaacggcaagcugugcaagcugaacggcauccccccccuggagcugggcgacugcagcaucgccggcuggcugcugggcaaccccgagugcgacagacugcugagcgugcccgaguggagcuacaucauggagaaggagaaccccagagacggccugugcuaccccggcagcuucaacgacuacgaggagcugaagcaccugcugagcagcgugaagcacuucgagaaggugaagauccugcccaagaacagauggacccagcacaccaccaccggcggcagcagagccugcgccgugagcggcaaccccagcuucuucagaaacaugguguggcugaccaagaagggcagcaacuaccccguggccaagggcagcuacaacaacaccagcggcgagcagaugcugaucaucuggggcgugcaccaccccaacgacgagaccgagcagagaacccuguaccagaacguggagaccuacgugagcgugagcaccagcacccugaacaagagaagcacccccaagaucgccaccagacccgaggugaacggccugggcagcagaauggaguucagcuggacccugcuggacaugugggacaccaucaacuucgagagcaccggcaaccugaucgcccccgaguacggcuucaagaucagcaagagaggcagcagcggcaucaugaagaccgagggcacccuggagaacugcgagaccaagugccagaccccccugggcgccaucaacaccacccugcccuuccacaacgugcacccccugaccaucggcgagugccccaaguacgugaagagcgagaagcuggugcuggccaccggccccagaaacgugccccagaucgagagcagaggccuguucggcgccaucgccggcuucaucgagggcggcuggcagggcaugguggacggcugguacggcuaccaccacagcaacgaccagggcagcggcuacgccgccgacaaggagagcacccagaaggccuucgacggcaucaccaacaaggugaacagcgugaucgagaagaugaacacccaguucgaggccgugggcaaggaguucagcaaccuggagagaagacuggagaaccugaacaagaagauggaggacggcuuccuggacguguggaccuacaacgccgagcugcuggugcugauggagaacgagagaacccuggacuuccacgacagcaacgugaagaaccuguacgacaaggugagaaugcagcugagagacaacgugaaggagcugggcaacggcugcuucgaguucuaccacaagugcgacgacgagugcaugaacagcgugaagaacggcaccuacgacuaccccaaguacgaggaggagagcaagcugaacagaaacgagaucaagggcgugaagcugagcagcaugggcguguaccagauccuggugaucuacgccaccguggccggcagccugagccuggccaucaugauggccggcaucagcuucuggaugugcagcaacggcagccugcagugcagaaucugcaucuga

SEQ ID NO: 158786 - RNA, 1701 nt, Artificial Sequence; identical to SEQ ID NO: 153284
  derived and/or modified sequence opt4 from hemagglutinin__InfluenzaA__ADT78971

SEQ ID NO: 158787 - RNA, 1701 nt, Artificial Sequence; identical to SEQ ID NO: 152825
  derived and/or modified sequence opt4 from hemagglutinin__InfluenzaA__ADT79010

SEQ ID NO: 158788 - RNA, 1701 nt, Artificial Sequence; identical to SEQ ID NO: 153284
  derived and/or modified sequence opt4 from hemagglutinin__InfluenzaA__ADT79030

SEQ ID NO: 158789 - RNA, 1701 nt, Artificial Sequence; identical to SEQ ID NO: 153862
  derived and/or modified sequence opt4 from hemagglutinin__InfluenzaA__ADT79050

SEQ ID NO: 158790 - RNA, 1701 nt, Artificial Sequence
  derived and/or modified sequence opt4 from hemagglutinin__InfluenzaA__ADT79108
augaaggccagacugcugauccugcugugcgcccugagcgccaccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcaacaucgccggcuggauccugggcaaccccgagugcgagagccugcugagcaacagaagcuggagcuacaucgccgagacccccaacagcgagaacggcaccugcuaccccggcgacuucgccgacuacgaggagcugagagagcagcugagcagcgugagcagcuucgagagauucgagaucuuccccaaggagagaagcuggcccaagcacaacaucaccagaggcgugaccgccgccugcagccacgccaagaagagcagcuucuacaagaaccugcuguggcugaccgaggccaacggcagcuaccccaaccugaucaagagcuacgugaacaacaaggagaaggaggugcuggugcuguggggcgugcaccaccccagcaacaucgaggaccagagaacccuguacagaaaggagaacgccuacgugagcguggugagcagcaacuacaacagaagauucacccccgagaucgccgagagacccaaggugagaggccaggccggcagaaugaacuacuacuggacccugcuggagcccggcgacaagaucaucuucgaggccaacggcaaccugaucgcccccugguacgccuucgcccugagcagaggccugggcagcggcaucaucaccagcaacgccagcauggacgagugcgacaccaagugccagaccccccagggcgccaucaacagcagccugcccuuccagaacauccaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagaaccagcugagaaacaacgccaaggagaucggcaacggcugcuucgaguucuaccacaagugcgacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 158791 - RNA, 1689 nt, Artificial Sequence
  derived and/or modified sequence opt4 from hemagglutinin__InfluenzaA__ADT79119
auggccaucaucuaccugauccugcuguucaccgccgugagaggcgaccagaucugcaucggcuaccacgccaacaacagcaccgagaagguggacaccauccuggagagaaacgugaccgugacccacgccaaggacauccuggagaagacccacaacggcaagcugugcaagcugaacggcauccccccccuggagcugggcgacugcagcaucgccggcuggcugcugggcaaccccgagugcgacagacugcugagcgugcccgaguggagcuacaucauggagaaggagaaccccagagacggccugugcuaccccggcagcuucaacgacuacgaggagcugaagcaccugcugagcagcgugaagcacuucgagaaggugaagauccugcccaaggacagauggacccagcacaccaccaccggcggcagcagagccugcgccgugagcggcaaccccagcuucuucagaaacaugguguggcugaccaagaagggcagcaacuaccccguggccaagggcagcuacaacaacaccagcggcgagcagaugcugaucaucuggggcgugcaccaccccaacgacgagaccgagcagagaacccuguaccagaacgugggcaccuacgugagcgugggcaccagcacccugaacaagagaagcacccccgacaucgccaccagacccaaggugaacggccugggcggcagaauggaguucagcuggacccugcuggacaugugggacaccaucaacuucgagagcaccggcaaccugaucgcccccgaguacggcuucaagaucagcaagagaggcagcagcggcaucaugaagaccgagggcacccugggcaacugcgagaccaagugccagaccccccugggcgccaucaacaccacccugcccuuccacaacgugcacccccugaccaucggcgagugccccaaguacgugaagagcgagaagcuggugcuggccaccggccugagaaacgugccccagaucgagagcagaggccuguucggcgccaucgccggcuucaucgagggcggcuggcagggcaugguggacggcugguacggcuaccaccacagcaacgaccagggcagcggcuacgccgccgacaaggagagcacccagaaggccuucgacggcaucaccaacaaggugaacagcgugaucgagaagaugaacacccaguucgaggccgugggcaaggaguucagcaaccuggagagaagacuggagaaccugaacaagaagauggaggacggcuuccuggacguguggaccuacaacgccgagcugcuggugcugauggagaacgagagaacccuggacuuccacgacagcaacgugaagaaccuguacgacaaggugagaaugcagcugagagacaacgugaaggagcugggcaacggcugcuucgaguucuaccacaagugcgacgacgagugcaugaacagcgugaagaacggcaccuacgacuaccccaaguacgaggaggagagcaagcugaacagaaacgagaucaagggcgugaagcugagcagcaugggcguguaccagauccuggccaucuacgccaccguggccggcagccugagccuggccaucaugauggccggcaucagcuucuggaugugcagcaacggcagccugcagugcagaaucugcaucuga

SEQ ID NO: 158792 - RNA, 1689 nt, Artificial Sequence
  derived and/or modified sequence opt4 from hemagglutinin__InfluenzaA__ADT79129
auggccaucaucuaccugauccugcuguucaccgccgugagaggcgaccagaucugcaucggcuaccacgccaacaacagcaccgagaagguggacaccauccuggagagaaacgugaccgugacccacgccaaggacauccuggagaagacccacaacggcaagcugugcaagcugaacggcauccccccccuggagcugggcgacugcagcaucgccggcuggcugcugggcaaccccgagugcgacagacugcugagagugcccgaguggagcuacaucauggagaaggagaaccccagagacggccugugcuaccccggcagcuucaacgacuacgaggagcugaagcaccugcugagcagcgugaagcacuucgagaaggugaagauccugcccaaggacagauggacccagcacaccaccaccggcggcagcagagccugcgccgugagcggcaaccccagcuucuucagaaacaugaucuggcugaccaagaagggcagcaacuaccccguggccaagggcagcuacaacaacaccagcggcgagcagaugcugaucaucuggggcgugcaccaccccaacgacgagaccgagcagagaacccuguaccagaacgugggcaccuacgugagcguggugaccagcacccugaacaagagaagcacccccaagaucgccaccagacccaaggugaacggccugggcggcagaauggaguucagcuggacccugcuggacaugugggacaccaucaacuucgagagcaccggcaaccugaucgcccccgaguacggcuucaagaucagcaagagaggcagcagcggcaucaugaagaccgagggcacccuggagaacugcgagaccaagugccagaccccccugggcgccaucaacaccacccugcccuuccacaacgugcacccccuggccaucggcgagugccccaaguacgugaagagcgagaagcuggugcuggccaccggccugagaaacgugccccagaucgagagcagaggccuguucggcgccaucgccggcuucaucgagggcggcuggcagggcaugguggacggcugguacggcuaccaccacagcaacgaccagggcagcggcuacgccgccgacaaggagagcacccagagagccuucgacggcaucaccaacaaggugaacagcgugaucgagaagaugaacacccaguucgaggccgugggcaaggaguucagcaaccuggagagaagacuggagaaccugaacaagaagauggaggacggcuuccuggacguguggaccuacaacgccgagcugcuggugcugauggagaacgagagaacccuggacuuccacgacagcaacgugaagaaccuguacgacaaggugagaaugcagcugagagacaacgugaaggagcugggcaacggcugcuucgaguucuaccacaagugcgacgacgagugcaugaacagcgugaagaacggcaccuacgacuaccccaaguacgaggaggagagcaagcugaacagaaacgagaucaagggcgugaagcugagcagcaugggcguguaccagauccuggccaucuacgccaccguggccggcagccugagccuggccaucaugauggccggcaucagcuucuggaugugcagcaacggcagccugcagugcagaaucugcaucuga

SEQ ID NO: 158793 - RNA, 1701 nt, Artificial Sequence
  derived and/or modified sequence opt4 from hemagglutinin__InfluenzaA__ADT79232
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacaagcaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgacgugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158794 - RNA, 1701 nt, Artificial Sequence
  derived and/or modified sequence opt4 from hemagglutinin__InfluenzaA__ADT79242
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagacccccagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158795 - RNA, 1701 nt, Artificial Sequence
  derived and/or modified sequence opt4 from hemagglutinin__InfluenzaA__ADT91182
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagccccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccaccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccacccccccaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacggcaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158796 - RNA, 1701 nt, Artificial Sequence
  derived and/or modified sequence opt4 from hemagglutinin__InfluenzaA__ADU20561
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugggcggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158797 - RNA, 1701 nt, Artificial Sequence
  derived and/or modified sequence opt4 from hemagglutinin__InfluenzaA__ADU20562
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaagaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158798 - RNA, 1701 nt, Artificial Sequence
  derived and/or modified sequence opt4 from hemagglutinin__InfluenzaA__ADU25478
auggaggccaagcuguucgugcuguucugcgccuucaccgcccugaaggccgacaccaucugcgugggcuaccacgccaacaacagcaccgacaccguggacaccauccuggagagaaacgugaccgugacccacagcgugaaccugcuggagagcagccacaacggcaagcugugcagccugaacggcaaggccccccugcagcugggcaacugcaacguggccggcuggauccugggcaaccccgagugcgaccugcugcugaccgugaacagcuggagcuacaucaucgagaccagcaccagcaagaacggcgccugcuaccccggcgaguucgccgacuacgaggagcugagagagcagcugagcaccgugagcagcuucgagagauucgagaucuuccccaaggccaccagcuggcccaaccacgagaccaccaagggcaccaccguggccugcagccacagcggcgccaacagcuucuacagaaaccugcuguggaucgugaagaagggcaacagcuaccccaagcugagcaagagcuacaccaacaacaagggcaaggaggugcuggugaucuggggcgugcaccacccccccaccgacagcgaccagcagacccuguaccagaacaaccacaccuacgugagcgugggcagcagcaaguacuaccagagauucacccccgagaucgugaccagacccaaggugagagagcaggccggcagaaugaacuacuacuggacccugcuggaccagggcgacaccaucaccuucgaggccaccggcaaccugaucgcccccuggcacgccuucgcccugaacaagggcagcagcagcggcaucaugaugagcgacgcccacgugcacaacugcaccaccaagugccagaccccccacggcgcccugaagagcaaccugcccuuccagaacgugcaccccaucaccaucggcgagugccccaaguacgugaagagcacccagcugagaauggccaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaucgccaucgacggcaucagcaacaaggugaacagcgugaucgagaagaugaacgugcaguucaccagcgugggcaaggaguucaacaaccuggagaagagaaucgagaaccugaacaagaagguggacgacggcuuccuggacaucuggaccuacaacgccgagcugcugauccugcuggagaacgagagaacccuggacuuccacgacuucaacgugaagaaccuguacgagagagugaagagccagcugagaaacaacgccaaggagaucggcaacggcugcuucgaguucuaccacaagugcaacaacgagugcauggagagcgugaagaacggcaccuacaacuaccccagauacagcgaggagagcaagcugaacagagaggagaucgacggcgugaagcuggagagcgugggcgugcaccagauccuggccaucuacagcaccguggccagcagccuggugcugcuggugagccugggcgccaucagcuucuggaugugcagcaacggcagccugcagugcagaaucugcaucuga

SEQ ID NO: 158799 - RNA, 1701 nt, Artificial Sequence
  derived and/or modified sequence opt4 from hemagglutinin__InfluenzaA__ADU59558
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagaggccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158800 - RNA, 1701 nt, Artificial Sequence; identical to SEQ ID NO: 155189
  derived and/or modified sequence opt4 from hemagglutinin__InfluenzaA__ADU59579

SEQ ID NO: 158801 - RNA, 1701 nt, Artificial Sequence; identical to SEQ ID NO: 155189
  derived and/or modified sequence opt4 from hemagglutinin__InfluenzaA__ADU59590

SEQ ID NO: 158802 - RNA, 1701 nt, Artificial Sequence; identical to SEQ ID NO: 155189
  derived and/or modified sequence opt4 from hemagglutinin__InfluenzaA__ADU59601

SEQ ID NO: 158803 - RNA, 1701 nt, Artificial Sequence; identical to SEQ ID NO: 155189
  derived and/or modified sequence opt4 from hemagglutinin__InfluenzaA__ADU59612

SEQ ID NO: 158804 - RNA, 1701 nt, Artificial Sequence; identical to SEQ ID NO: 155189
  derived and/or modified sequence opt4 from hemagglutinin__InfluenzaA__ADU59768

SEQ ID NO: 158805 - RNA, 1701 nt, Artificial Sequence; identical to SEQ ID NO: 155189
  derived and/or modified sequence opt4 from hemagglutinin__InfluenzaA__ADU59769

SEQ ID NO: 158806 - RNA, 1701 nt, Artificial Sequence; identical to SEQ ID NO: 155189
  derived and/or modified sequence opt4 from hemagglutinin__InfluenzaA__ADU59771

SEQ ID NO: 158807 - RNA, 1701 nt, Artificial Sequence; identical to SEQ ID NO: 155189
  derived and/or modified sequence opt4 from hemagglutinin__InfluenzaA__ADU59772

SEQ ID NO: 158808 - RNA, 1701 nt, Artificial Sequence; identical to SEQ ID NO: 155189
  derived and/or modified sequence opt4 from hemagglutinin__InfluenzaA__ADU59774

SEQ ID NO: 158809 - RNA, 1701 nt, Artificial Sequence; identical to SEQ ID NO: 155189
  derived and/or modified sequence opt4 from hemagglutinin__InfluenzaA__ADU59906

SEQ ID NO: 158810 - RNA, 1701 nt, Artificial Sequence; identical to SEQ ID NO: 155189
  derived and/or modified sequence opt4 from hemagglutinin__InfluenzaA__ADU59916

SEQ ID NO: 158811 - RNA, 1701 nt, Artificial Sequence; identical to SEQ ID NO: 155189
  derived and/or modified sequence opt4 from hemagglutinin__InfluenzaA__ADU76756

SEQ ID NO: 158812 - RNA, 1701 nt, Artificial Sequence; identical to SEQ ID NO: 155189
  derived and/or modified sequence opt4 from hemagglutinin__InfluenzaA__ADU76757

SEQ ID NO: 158813 - RNA, 1701 nt, Artificial Sequence; identical to SEQ ID NO: 155189
  derived and/or modified sequence opt4 from hemagglutinin__InfluenzaA__ADU76758

SEQ ID NO: 158814 - RNA, 1701 nt, Artificial Sequence; identical to SEQ ID NO: 155189
  derived and/or modified sequence opt4 from hemagglutinin__InfluenzaA__ADU76759

SEQ ID NO: 158815 - RNA, 1701 nt, Artificial Sequence; identical to SEQ ID NO: 155549
  derived and/or modified sequence opt4 from hemagglutinin__InfluenzaA__ADU76761

SEQ ID NO: 158816 - RNA, 1701 nt, Artificial Sequence; identical to SEQ ID NO: 155189
  derived and/or modified sequence opt4 from hemagglutinin__InfluenzaA__ADU76762

SEQ ID NO: 158817 - RNA, 1701 nt, Artificial Sequence
  derived and/or modified sequence opt4 from hemagglutinin__InfluenzaA__ADU76764
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggaggccagcagcagcaacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaucgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158818 - RNA, 1701 nt, Artificial Sequence
  derived and/or modified sequence opt4 from hemagglutinin__InfluenzaA__ADU76765
augaaggccauccugaucgugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcagcguggccagcagccuggugcugguggugagccugggcgccaucagcuucuggaugugcagcaacggcagccugcagugcagaaucugcaucuga

SEQ ID NO: 158819 - RNA, 1701 nt, Artificial Sequence; identical to SEQ ID NO: 156786
  derived and/or modified sequence opt4 from hemagglutinin__InfluenzaA__ADU76766

SEQ ID NO: 158820 - RNA, 1701 nt, Artificial Sequence
  derived and/or modified sequence opt4 from hemagglutinin__InfluenzaA__ADU76767
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158821 - RNA, 1701 nt, Artificial Sequence
  derived and/or modified sequence opt4 from hemagglutinin__InfluenzaA__ADU76768
augaaggccauccugguggugcugcuguacaccuucgccaucgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcaaguacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagcacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucaacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158822 - RNA, 1701 nt, Artificial Sequence; identical to SEQ ID NO: 155189
  derived and/or modified sequence opt4 from hemagglutinin__InfluenzaA__ADU76769

SEQ ID NO: 158823 - RNA, 1701 nt, Artificial Sequence; identical to SEQ ID NO: 155189
  derived and/or modified sequence opt4 from hemagglutinin__InfluenzaA__ADU76770

SEQ ID NO: 158824 - RNA, 1701 nt, Artificial Sequence; identical to SEQ ID NO: 155189
  derived and/or modified sequence opt4 from hemagglutinin__InfluenzaA__ADU76771

SEQ ID NO: 158825 - RNA, 1701 nt, Artificial Sequence; identical to SEQ ID NO: 155934
  derived and/or modified sequence opt4 from hemagglutinin__InfluenzaA__ADU76772

SEQ ID NO: 158826 - RNA, 1701 nt, Artificial Sequence; identical to SEQ ID NO: 155189
  derived and/or modified sequence opt4 from hemagglutinin__InfluenzaA__ADU76774

SEQ ID NO: 158827 - RNA, 1701 nt, Artificial Sequence; identical to SEQ ID NO: 155189
  derived and/or modified sequence opt4 from hemagglutinin__InfluenzaA__ADU76775

SEQ ID NO: 158828 - RNA, 1701 nt, Artificial Sequence; identical to SEQ ID NO: 155189
  derived and/or modified sequence opt4 from hemagglutinin__InfluenzaA__ADU76776

SEQ ID NO: 158829 - RNA, 1701 nt, Artificial Sequence; identical to SEQ ID NO: 155189
  derived and/or modified sequence opt4 from hemagglutinin__InfluenzaA__ADU76777

SEQ ID NO: 158830 - RNA, 1701 nt, Artificial Sequence; identical to SEQ ID NO: 155189
  derived and/or modified sequence opt4 from hemagglutinin__InfluenzaA__ADU76778

SEQ ID NO: 158831 - RNA, 1701 nt, Artificial Sequence; identical to SEQ ID NO: 158047
  derived and/or modified sequence opt4 from hemagglutinin__InfluenzaA__ADU76779

SEQ ID NO: 158832 - RNA, 1701 nt, Artificial Sequence; identical to SEQ ID NO: 155189
  derived and/or modified sequence opt4 from hemagglutinin__InfluenzaA__ADU76780

SEQ ID NO: 158833 - RNA, 1701 nt, Artificial Sequence; identical to SEQ ID NO: 156786
  derived and/or modified sequence opt4 from hemagglutinin__InfluenzaA__ADU76781

SEQ ID NO: 158834 - RNA, 1701 nt, Artificial Sequence; identical to SEQ ID NO: 155549
  derived and/or modified sequence opt4 from hemagglutinin__InfluenzaA__ADU76782

SEQ ID NO: 158835 - RNA, 1701 nt, Artificial Sequence
  derived and/or modified sequence opt4 from hemagglutinin__InfluenzaA__ADU76784
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcaacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158836 - RNA, 1701 nt, Artificial Sequence; identical to SEQ ID NO: 155189
  derived and/or modified sequence opt4 from hemagglutinin__InfluenzaA__ADU76785

SEQ ID NO: 158837 - RNA, 1701 nt, Artificial Sequence; identical to SEQ ID NO: 155189
  derived and/or modified sequence opt4 from hemagglutinin__InfluenzaA__ADU76786

SEQ ID NO: 158838 - RNA, 1701 nt, Artificial Sequence
  derived and/or modified sequence opt4 from hemagglutinin__InfluenzaA__ADU76787
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccacaacauccacagcaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158839 - RNA, 1701 nt, Artificial Sequence; identical to SEQ ID NO: 158820
  derived and/or modified sequence opt4 from hemagglutinin__InfluenzaA__ADU76788

SEQ ID NO: 158840 - RNA, 1701 nt, Artificial Sequence; identical to SEQ ID NO: 158820
  derived and/or modified sequence opt4 from hemagglutinin__InfluenzaA__ADU76789

SEQ ID NO: 158841 - RNA, 1701 nt, Artificial Sequence; identical to SEQ ID NO: 155189
  derived and/or modified sequence opt4 from hemagglutinin__InfluenzaA__ADU76790

SEQ ID NO: 158842 - RNA, 1701 nt, Artificial Sequence; identical to SEQ ID NO: 155189
  derived and/or modified sequence opt4 from hemagglutinin__InfluenzaA__ADU76791

SEQ ID NO: 158843 - RNA, 1701 nt, Artificial Sequence; identical to SEQ ID NO: 158820
  derived and/or modified sequence opt4 from hemagglutinin__InfluenzaA__ADU76792

SEQ ID NO: 158844 - RNA, 1701 nt, Artificial Sequence
  derived and/or modified sequence opt4 from hemagglutinin__InfluenzaA__ADU76793
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagaaguucgagaucuuccccaagaccagcagcuggcccaaccacgacagcaacaagggcgugaccgccgccugcccccacgccggcaccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158845 - RNA, 1701 nt, Artificial Sequence
  derived and/or modified sequence opt4 from hemagglutinin__InfluenzaA__ADU85911
augaaggccaucaucguggugcugcuguacaccuucgccaccgccgacgccgacacccugugcaucggcuaccacgccaacaacagcaccgacaccguggacaccgugcuggagaagaacgugaccgugacccacagcgugaaccugcuggagaacaagcacaacggcaagcugugcaagcugggcggcaucgccccccugcaccugggcaagugcgacaucgccggcuggcugcugggcaaccccgagugcgagagccuguucaccgccagcagcuggagcuacaucguggagacccccaacagcgacaacggcaccugcuaccccggcgacuucaucaacuacgaggagcugagagagcaccugagcagcgugagcagcuucgagagauucgagaucuuccccaaggccaacagcuggcccaaccacgacaccaacaagggcgugaccgccgccugccccuacgccggcgccaacagcuucuacagaaaccugaucuggcuggugaagaagggcaacagcuaccccaagcugagcaagagcuacaucaacaacaagaagaaggaggugcuggugaucuggggcauccaccacccccccaccagcaccgaccagcagacccuguaccagaacgccgacgccuacguguucgugggcagcagcaaguacagcaagagauucaagcccgagaucgccgccagacccaaggugagagaccaggccggcagaauggacuacuacuggacccugaucgagcccggcgacaccaucaccuucgaggccaccggcaaccugguggugcccagauacgccuucgccaugaagagaggcagcggcagcggcaucaucgugagcgacgcccccgugcacgacugcaacaccaccugccagacccccaagggcgccaucaacaccagccugcccuuccagaacauccaccccgugaccaucggcgagugccccaaguacgugaagagcaccaagcugagaauggccaccggccugagaaacauccccagcauccagagcagaggccuguucggcgccaucgccggcuuccuggagggcggcuggaccggcaugaucgacggcugguacggcuaccaccaccagaacgagcagggcagcggcuacgccgccgaccagaagagcacccagaacgccaucgacggcaucaccaacaaggugaacagcaucaucgagaagaugaacacccaguucaccgccgugggcaaggaguucagccagcuggagaagagaaucgagagccugaacaacaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcgccagaaucuaccagauccuggccaucuacagcaccguggccagcagccuggugcugcuggugagccugggcgccaucagcuucuggaugugcagcaacggcagccugcagugcagaaucugcaucuga

SEQ ID NO: 158846 - RNA, 1701 nt, Artificial Sequence; identical to SEQ ID NO: 156353
  derived and/or modified sequence opt4 from hemagglutinin__InfluenzaA__ADV17283

SEQ ID NO: 158847 - RNA, 1701 nt, Artificial Sequence; identical to SEQ ID NO: 156353
  derived and/or modified sequence opt4 from hemagglutinin__InfluenzaA__ADV17293

SEQ ID NO: 158848 - RNA, 1701 nt, Artificial Sequence
  derived and/or modified sequence opt4 from hemagglutinin__InfluenzaA__ADV17303
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaagggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158849 - RNA, 1701 nt, Artificial Sequence; identical to SEQ ID NO: 156353
  derived and/or modified sequence opt4 from hemagglutinin__InfluenzaA__ADV17313

SEQ ID NO: 158850 - RNA, 1701 nt, Artificial Sequence
  derived and/or modified sequence opt4 from hemagglutinin__InfluenzaA__ADV17323
augaaggccauccugguggugcugcuguacaccuucgccaccaccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccaacagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagggccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacuacgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158851 - RNA, 1701 nt, Artificial Sequence
  derived and/or modified sequence opt4 from hemagglutinin__InfluenzaA__ADV17333
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagaaccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcugagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuacuacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggugaucuacagcaccguggccagcagccuggugcugguggugagccugggcgccaucagcuucuggaugugcagcaacggcagccugcagugcagaaucugcaucuga

SEQ ID NO: 158852 - RNA, 1701 nt, Artificial Sequence; identical to SEQ ID NO: 155189
  derived and/or modified sequence opt4 from hemagglutinin__InfluenzaA__ADV19019

SEQ ID NO: 158853 - RNA, 1701 nt, Artificial Sequence; identical to SEQ ID NO: 155674
  derived and/or modified sequence opt4 from hemagglutinin__InfluenzaA__ADV41677

SEQ ID NO: 158854 - RNA, 1701 nt, Artificial Sequence
  derived and/or modified sequence opt4 from hemagglutinin__InfluenzaA__ADV58939
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacgagaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158855 - RNA, 1698 nt, Artificial Sequence
  derived and/or modified sequence opt4 from hemagglutinin__InfluenzaA__ADV69074
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcaacguggccggcuggauccugggcaaccccgagugcgagcugcugaucagcaaggagagcuggagcuacaucguggagacccccgaccccgagaacggcaccugcuaccccggcuacuucaccgacuacgaggagcugagagagcagcugagcagcgugagcagcuucaagagauucgagaucuuccccaaggagagcagcuggcccaaccacaccgugaccggcgugagcgccagcugcagccacaacggcaagagcagcuucuacagaaaccugcuguggcugaccgugaagaacggccuguaccccaaccugagcaagagcuacaccaacgacaaggagaaggaggugcuggugcuguggggcgugcaccacccccccagcaucggcgaccagagaacccuguaccacaccgagaacgccuacgugagcguggugagcagccacuacagcagaagauucacccccgagaucgugaagagacccaaggugagagaccaggagggcagaaucaacuacuacuggacccugcuggagcccggcgacaccaucaucugcgaggccaacggcaaccugaucgcccccagauacgccuucgcccugagcagaggccugggcagcggcaucaucaccagcaacgcccccaugggcgagugcaacgccaagugccagaccccccagggcgccaucaacagcagccugcccuuccagaacgugcaccccgugaccaucggcgagugccccaaguacgugaagagcgccaagcugagaauggugaccggccugagaaacacccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcauggagguguaccagauccuggccaucuacagcaccguggccagcagccugguguuccugguggcccugggcgccaucugcuucuggaugugcagcaacggcagccugcagugcaagaucugcaucuga

SEQ ID NO: 158856 - RNA, 1698 nt, Artificial Sequence
  derived and/or modified sequence opt4 from hemagglutinin__InfluenzaA__ADV69075
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcaacguggccggcuggauccugggcaaccccgagugcgagcugcugaucagcaaggagagcuggagcuacaucguggagacccccgaccccgagaacggcaccugcuaccccggcuacgugaccgacuacgaggagcugagagagcagcugagcagcgugagcagcuucaagagauucgagaucuuccccaaggagagcagcuggcccaaccacaccgugaccggcgugagcgccagcugcagccacaacggcaagagcagcuucuacagaaaccugcuguggcugaccgugaagaacggccuguaccccaaccugagcaagagcuacaccaacgacaaggagaaggaggugcuggugcuguggggcgugcaccacccccccagcaucggcgaccagagaacccuguaccacaccgagaacgccuacgugagcguggugagcagccacuacagcagaagauucacccccgagaucgugaagagacccaaggugagagaccaggagggcagaaucaacuacuacuggacccugcuggagcccggcgacaccaucaucugcgaggccaacggcaaccugaucgcccccagauacgccuucgcccugagcagaggcuucggcagcggcaucaucaccagcaacgcccccaugggcgagugcaacgccaagugccagaccccccagggcgccaucaacagcagccugcccuuccagaacgugcaccccgugaccaucggcgagugccccaaguacgugaagagcgccaagcugagaauggugaccggccugagaaacacccccagcauccagagcagaggccuguucggcgccaucgccggcuucaucgagggcggcuggaccggcaugguggacggcugguacggcuaccaccaccccaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaaggugaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcauggagguguaccagauccuggccaucuacagcaccguggccagcagccugguguuccugguggcccugggcgccaucugcuucuggaugugcagcaacggcagccugcagugcaagaucugcaucuga

SEQ ID NO: 158857 - RNA, 1698 nt, Artificial Sequence
  derived and/or modified sequence opt4 from hemagglutinin__InfluenzaA__ADV69077
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcaacguggccggcuggauccugggcaaccccgagugcgagcugcugaucagcaaggagagcuggagcuacaucguggagacccccgaccccgagaacggcaccugcuaccccggcuacuucaccgacuacgaggagcugagagagcagcugagcagcgugagcagcuucaagagauucgagaucuuccccaaggagagcagcuggcccaaccacaccgugaccggcgugagcgccagcugcagccacaacggcaagagcagcuucuacagaaaccugcuguggcugaccgugaagaacggccuguaccccaaccugagcaagagcuacaccaacgacaaggagaaggaggugcuggugcuguggggcgugcaccacccccccagcaucggcgaccagagaacccuguaccacaccgagaacgccuacgugagcguggugagcagccacuacagcagaagauucacccccgagaucgugaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaccagcaacgcccccaugggcgagugcaacgccaagugccagaccccccagggcgccaucaacagcagccugcccuuccagaacgugcaccccgugaccaucggcgagugccccaaguacgugaagagcgccaagcugagaauggugaccggccugagaaacacccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcauggagguguaccagauccuggccaucuacagcaccguggccagcagccugguguuccugguggcccugggcgccaucugcuucuggaugugcagcaacggcagccugcagugcaagaucugcaucuga

SEQ ID NO: 158858 - RNA, 1698 nt, Artificial Sequence
  derived and/or modified sequence opt4 from hemagglutinin__InfluenzaA__ADV69078
augaaggugaagcugcugauccugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagagccugaucagcaagaagagcuggagcuacaucguggagacccccaaccccgagaacggcgccugcuaccccggcgaguucgccgacuacgaggagcugagagagcagcugagcagcgugagcagcuucgagagauucgagaucuuccccaaggagagcagcuggcccaaccacaccgccgccggcgugagcgccagcugcagccacaacggcgagaagagcuucuacagaaaccugaucuggcugaccaagaagaacggccuguaccccaaccugagcaagagcuacgagaacgacaaggagaaggaggugcugauccuguggggcgugcaccacccccccaacaucgagaaccagagaacccuguacagaaccgagaacgccuacgugagcguggugagcagccacuacagcggcagauucacccccgagaucaccaagagacccaaggugagaaaccaggagggcagaaucaacuacuacuggacccugcuggagcccggcgacaccaucaucuucgaggccaacggcaaccugaucgcccccugguacgccuucacccugagcagaggccugggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcagcaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccaggagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagagccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggacagcaugggcguguacagaauccuggccaucuacagcaccguggccagcagccuggugcugcuggugagccugggcgccaucagcuucuggaugugcagcaacggcagccugcagugcagaaucugcaucuga

SEQ ID NO: 158859 - RNA, 1698 nt, Artificial Sequence
  derived and/or modified sequence opt4 from hemagglutinin__InfluenzaA__ADV69079
augaaggugaagcugcugauccugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaagaagagcuggagcuacaucgugaagacccccaaccccgagaacggcagcugcuaccccggcuacuucgccgacuacgaggagcugagagagcagcugagcagcgugagcagcuucgagagauucgagauguuccccaaggagagcagcuggcccaaccacaacgugaacggcgugagcgccagcugcagccacaacggcaagagaagcuucuacagaaaccugcuguggcugaccggcaagaacggccuguaccccaaccugaccaagagcuacgagaacaacaacgagaaggaggugcugauccuguggggcgugcaccaccccagcaacaucggcgaccagagaacccuguaccacaccgagaacgccuacgugagcgugaugagcagccacuacagcagaagauucacccccgagaucaacaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcagcgcccccauggacgagugcgacgccaagugccagacccccagaggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccaggagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagagccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggacagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 158860 - RNA, 1698 nt, Artificial Sequence
  derived and/or modified sequence opt4 from hemagglutinin__InfluenzaA__ADV69080
augaaggugaagcugcugauccugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagagccugaucagcaagaagagcuggagcuacaucguggagacccccaaccccgagaacggcgccugcuaccccggcgaguucgccgacuacgaggagcugagagagcagcugagcagcgugagcagcuucgagagauucgagaucuuccccaaggagagcagcuggcccaaccacaccgccgccggcgugagcgccagcugcagccacaacggcgagagaagcuucuacagaaaccugaucuggcugaccaugaagaacggccuguaccccaaccugagaaagagcuacgagaacgacaaggagaaggaggugcugauccuguggggcgugcaccacccccccaacaucgagaaccagagaacccuguaccacaccgagaacgccuacgugagcguggugagcagccacuacagcggcagauucacccccgagaucaccaagagacccaaggugagagaccaggagggcagaaucaacuacuacuggacccugcuggagcccggcgacaccaucaucuucgaggccaacggcaaccugaucgcccccugguacgccuucacccugagcagaggccugggcagcggcaucaucaccagcaacgcccccauggacgccugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccaggagagcacccagaacgccaucaacggcaucaccaacaaggugaacagcgugaucgagaagaugaacacccaguucaccgccgugggcaaggaguucaacaagcuggagagaagaaucgagaaccugaacaagaagguggacgacggcuucaucgacaucuggaccuacaacgccgagcugcuggugcugcuggagaacgagagaacccuggacuuccacgacagcaacgugaagagccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggacagcaugggcguguacagaauccuggccaucuacagcaccguggccagcagccuggugcugcuggugagccugggcgccaucagcuucuggaugugcagcaacggcagccugcagugcagaaucugcaucuga

SEQ ID NO: 158861 - RNA, 1698 nt, Artificial Sequence
  derived and/or modified sequence opt4 from hemagglutinin__InfluenzaA__ADV69081
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcaacguggccggcuggauccugggcaaccccgagugcgagcugcugaucagcaaggagagcuggagcuacaucguggagacccccaaccccgagaacggcaccugcuaccccggcuacuucaccgacuacgaggagcugagagagcagcugagcagcgugagcagcuucaagagauucgagaucuuccccaaggagagcagcuggcccaaccacaccgugaccggcgugagcgccagcugcagccacaacggcgagagcagcuucuacagaaaccugcuguggcugaccgugaagaacggccuguaccccaagcugagcaagagcuacaccaacgacaaggagaaggaggugcuggugcuguggggcgugcaccacccccccaacaucagagaccagagaacccuguaccacaccgagaacgccuacgugagcguggugagcagccacuacagcagaagauucacccccgagaucgugaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaccagcaacgcccccaugggcgagugcaacgccaagugccagaccccccagggcgccaucaucagcagccugcccuuccagaacgugcaccccgugaccaucggcgagugccccaaguacgugaagagcgccaagcugagaauggugaccggccugagaaacacccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcauggagguguaccagauccuggccaucuacagcaccguggccagcagccugguguuccugguggcccugggcgccaucugcuucuggaugugcagcaacggcagccugcagugcaagaucugcaucuga

SEQ ID NO: 158862 - RNA, 1698 nt, Artificial Sequence
  derived and/or modified sequence opt4 from hemagglutinin__InfluenzaA__ADV69083
augaaggugaagcugauggugcugcugugcaccuucaccgccaccuacgccgacaccaucugcgugggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcagcugcagcguggccggcuggauccugggcaaccccgagugcgagcugcugaucagcaaggagagcuggagcuacaucguggagacccccaaccccgagaacggcaccugcuaccccggcuacuucaccgacuacgaggagcugagagagcagcugagcagcgugagcagcuucaagagauucgagaucuuccccaaggagagcagcuggcccaaccacaacgugaccggcgugagcagcagcugcagccacaacggcaagagcagcuucuacagaaaccugcuguggcugaccgugaagaacggccuguaccccaaccugagcaagagcuacaccaacaagaaggagaaggaggugcuggugcuguggggcgugcaccaccccagcaacaucggcgaccagagagcccuguaccacaccgagaacgccuacgugagcguggugagcagccacuacagcagaagauucacccccgagaucgccaagagacccaaggugagaaaccaggagggcagaaucaacuacuacuggacccugcuggagcccggcgacaccaucauccuggaggccaacggcaaccugaucgcccccagauacgccuucgagcugagcaagggccugggcagcggcaucaucaccagcaacgcccccaugggcgagugcaacgccaagugccagaccccccagggcgccaucaacagcagccugcccuuccagaacgugcaccccgugaccaucggcgagugccccaaguacgugaagagcgccaagcugagaauggugaccggccugagaaacacccccagcauccagagcagaggccuguucggcgccaucgccggcuucaucgagggcggcuggaccggcaugguggacggcugguacggcuaccaccaccagaacgagcagggcagcggcuacgccgccgaccagcagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguacaacauccuggccaucuacagcaccguggccagcagccuggugcugcuggugagccugggcgccaucagcuucuggaugugcagcaacggcagccugcagugcagaaucugcaucuga

SEQ ID NO: 158863 - RNA, 1698 nt, Artificial Sequence
  derived and/or modified sequence opt4 from hemagglutinin__InfluenzaA__ADV69084
augaaggugaagcugauggugcugcugugcaccuucaccgccaccuacgccgacaccaucugcgugggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcagcugcagcguggccggcuggauccugggcaaccccgagugcgagcugcugaucagcaaggagagcuggagcuacaucguggagacccccaaccccgagaacggcaccugcuaccccggcuacuucaccgacuacgaggagcugagagagcagcugagcagcgugagcagcuucaagagauucgagaucuuccccaaggagagcagcuggcccaaccacaacgugaccggcgugagcagcagcugcagccacaacggcaagagcagcuucuacagaaaccugcuguggcugaccgugaagaacggccuguaccccaaccugagcaagagcuacaccaacaagaaggagaaggaggugcugauccuguggggcgugcaccaccccagcaacaucagagaccagagagcccuguacuacaccgagaacgccuacgugagcguggugagcagccacuacagcagaagauucacccccgagaucgccaagagacccaaggugagaaaccaggagggcagaaucaacuacuacuggacccugcuggagcccggcgacaccaucaucuucgaggccaacggcaaccugaucgcccccagauacgccuucgagcugagcaagggcuucggcagcggcaucaucaccagcgacgcccccaugggcgagugcaacgccaagugccagaccccccagggcgccaucaacagcagccugcccuuccagaacgugcaccccgugaccaucggcgagugccccaaguacgugagaagcgccaagcugagaauggugaccggccugagaaacacccccagcauccagagcagaggccuguucggcgccaucgccggcuucaucgagggcggcuggaccggcaugguggacggcugguacggcuaccaccaccagaacgagcagggcagcggcuacgccgccgaccagcagagcacccagaacgccaucaacggcaucaccaacaaggugaacagcgugaucgagaagaugaacacccaguucaccgccgugggcaaggaguucaacaagcuggagagaagaauggagaaccugaacaagaagaucgacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguacaacauccuggccaucuacagcaccguggccagcagccuggugcugcuggugagccugggcgccaucagcuucuggaugugcagcaacggcagccugcagugcagaaucugcaucuga

SEQ ID NO: 158864 - RNA, 1698 nt, Artificial Sequence
  derived and/or modified sequence opt4 from hemagglutinin__InfluenzaA__ADV69085
augaaggugaagcugauggugcugcugugcaccuucaccgccaccuacgccgacaccaucugcgugggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcagcugcagcguggccggcuggauccugggcaaccccgagugcgagcugcugaucagcaaggagagcuggagcuacaucguggagacccccaaccccgagaacggcaccugcuaccccggcuacuucaccgacuacgaggagcugagagagcagcugagcagcgugagcagcuucaagagauucgagaucuuccccaaggagagcagcuggcccaaccacaccgugaccggcgugagcagcagcugcagccacaacggcaagagcagcuucuacagaaaccugcuguggcugaccaugaagaacggccuguaccccaaccugagcaagagcuacaccaacaagaaggagaaggaggugcuggugcuguggggcgugcaccaccccagcaacaucggcgaccagagagcccuguaccacaccgagaacgccuacgugagcguggugagcagccacuacagcagaagauucacccccgagaucgccaagagacccaaggugagaaaccaggagggcagaaucaacuacuacuggacccugcuggagcccggcgacaccaucaucuucgaggccaacggcaaccugaucgcccccagauacgccuucgagcugagcaagggcuucggcagcggcaucaucaccagcaacgcccccaugggcgagugcaacgccaagugccagaccccccagggcgccaucaacagcagccugcccuuccagaacgugcaccccgugaccaucggcgagugccccaaguacgugagaagcagcaagcugagaauggugaccggccugagaaacacccccagcauccagagcagaggccuguucggcgccaucgccggcuucaucgagggcggcuggaccggcaugguggacggcugguacggcuaccaccaccagaacgagcagggcagcggcuacgccgccgaccagcagagcacccagaacgccaucaacggcaucaccaacaaggugaacagcgugaucgagaagaugaacacccaguucaccgccgugggcaaggaguucaacaagcuggagagaagaauggagaaccugaacaagaagaucgacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguacaacauccuggccaucuacagcaccguggccagcagccuggugcugcuggugagccugggcgccaucagcuucuggaugugcagcaacggcagccugcagugcagaaucugcaucuga

SEQ ID NO: 158865 - RNA, 1698 nt, Artificial Sequence
  derived and/or modified sequence opt4 from hemagglutinin__InfluenzaA__ADV69086
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcaacguggccggcuggauccugggcaaccccgagugcgagcugcugaucagcaaggagagcuggagcuacaucguggagacccccaaccccgagaacggcaccugcuaccccggcuacuucaccgacuacgaggagcugagagagcagcugagcagcgugagcagcuucaagagauucgagaucuuccccaaggagagcagcuggcccaagcacaccgugaccggcgugagcgccagcugcagccacaacggcaagagcagcuucuacagaaaccugcuguggcugaccggcaagaacggccuguaccccaaccugagcaagagcuacaccaacgacaaggagaaggaggugcuggugcuguggggcgugcaccaccccagcaacaucggcgaccagagagcccuguaccacaaggagaacgccuacgugagcguggugagcagccacuacagcagaagauucacccccgagaucgugaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaccagcaacgcccccauggacgagugcaacaccaagugccagaccccccagggcgccaucaacagcagccugcccuuccagaacgugcaccccgugaccaucggcgagugccccaaguacgugaagagcgccaagcugagaauggugaccggccugagaaacacccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcauggagguguaccagauccuggccaucuacagcaccguggccagcagccugguguuccuggugagccugggcgccaucugcuucuggaugugcagcaacggcagccugcagugcagaaucugcaucuga

SEQ ID NO: 158866 - RNA, 1698 nt, Artificial Sequence
  derived and/or modified sequence opt4 from hemagglutinin__InfluenzaA__ADV69087
augaaggugaagcugauggugcugcugugcaccuucaccgccaccuacgccgacaccaucugcgugggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcagcugcagcguggccggcuggauccugggcaaccccgagugcgagcugcugaucagcaaggagagcuggagcuacaucguggagacccccaaccccgagaacggcaccugcuaccccggcuacuucaccgacuacgaggagcugagagagcagcugagcagcgugagcagcuucaagagauucgagaucuuccccaaggagagcagcuggcccaaccacaccgugaacggcgugagcagcagcugcagccacaacggcgagagcagcuucuacagaaaccugcuguggcugaccgugaaggacggccuguaccccaaccugagcaagagcuacaccaacaagaaggagaaggaggugcuggugcuguggggcgugcaccaccccagcaacaucggcgaccagagagcccuguaccacaccgagaacgccuacgugagcguggugagcagccacuacagcagaagauucacccccgagaucgccaagagacccaaggugagaaaccaggagggcagaaucaacuacuacuggacccugcuggagcccggcgacaccaucaucuucgaggccaacggcaaccugaucgcccccagauacgccuucgagcugagcaagggcuucggcagcggcaucaucaccagcaacgcccccaugggcgagugcaacgccaagugccagaccccccagggcgccaucaacagcagccugcccuuccagaacgugcaccccgugaccaucggcgagugccccaaguacgugagaagcaccaagcugagaauggugaccggccugagaaacacccccagcauccagagcagaggccuguucggcgccaucgccggcuucaucgagggcggcuggaccggcaugguggacggcugguacggcuaccaccaccagaacgagcagggcagcggcuacgccgccgaccagcagagcacccagaacgccaucaacggcaucaccaacaaggugaacagcgugaucgagaagaugaacacccaguucaccgccgugggcaaggaguucaacaagcuggagagaagaauggagaaccugaacaagaagaucgacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguacaacauccuggccaucuacagcaccguggccagcagccuggugcugcuggugagccugggcgccaucagcuucuggaugugcagcaacggcagccugcagugcagaaucugcaucuga

SEQ ID NO: 158867 - RNA, 1698 nt, Artificial Sequence
  derived and/or modified sequence opt4 from hemagglutinin__InfluenzaA__ADV69088
augaaggugaagcugcugauccugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcgugaccggcuggauccugggcaaccccgagugcgagcugcugaucagcaagaagagcuggagcuacaucguggagacccccaaccccgagaacggcgccugcuaccccggcuacuucgccgacuacgaggagcugagagagcagcugagcagcgugagcagcuucgagagauucgagaucuuccccaaggagagcagcuggcccaaccacaacgugaacggcgugagcgccagcugcagccacaacggcaagagcagcuucuacagaaaccugcuguggcugaccggcaagaacggccuguaccccagccugaccaagagcuacgccaacgacaaggagaaggaggugcugauccuguggggcgugcaccaccccagcaacaucggcgaccagagaacccuguaccacaccgagaacgccuacgugagcgugaugagcagccacuacagcagaagauucacccccgagaucagcaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcagcgcccccauggacgccugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccaggagagcacccagaacgcccugcacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagagccuguacgagaaggugaagauccagcugaagaacaacgccaaggagaucggcaacggcugcuucgaguucuaccacaagugcaacaacgagugcauggagagcgugagaaacggcaccuacgacuaccccaaguacagcgaggagagcaagcugaacagagagaagaucgacggcgugaagcuggacagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 158868 - RNA, 1698 nt, Artificial Sequence
  derived and/or modified sequence opt4 from hemagglutinin__InfluenzaA__ADV69089
augaaggugaagcugcugauccugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaagaagagcuggagcuacaucguggagacccccaaccccgagaacggcgccugcuaccccggcuacuucgccgacuacgaggagcugagagagcagcugagcagcgugagcagcuucgagagauucgagaucuuccccaaggagagcagcuggcccaaccacaacgugaacggcgugagcgccagcugcagccacaacggcaagagcagcuucuacagaaaccugcuguggcugaccggcaagaacggccuguaccccaaccugaccaagagcuacgccaacaacaaggagaaggaggugcugauccuguggggcgugcaccaccccagcaacaucggcgaccagagaacccuguaccacaccgagaacgccuacgugagcgugaugagcagccacuacagcagaagauucacccccgagaucaccaagagacccaagaucagagaccaggagggcagaaucaacuacuacuggacccugcuggagcccggcgacaccaucaucuacgaggccaacggcaaccugaucgcccccugguacgccuucgcccugagcagaggcuucggcagcggcaucaucaccagcagcgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcauggugaacggcugguacggcuacagacugcacaacgaccagggcagcggcuacgccgccgaccagaagagcacccagaacgcccugaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagaugcuggugcugcuggagaacgagagaacccuggacuuccacgacagcaacgugaagagccuguacgagagagugaagauccagcugaagaacaacgccaaggagaucggcaacggcugcuucgaguucuaccacaagugcaacaacgagugcauggagagcgugagaaacggcaccuacgacuaccccaaguacagcgaggagagcaagcugaacagagagaagaucgacggcgugaagcuggacagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 158869 - RNA, 1698 nt, Artificial Sequence
  derived and/or modified sequence opt4 from hemagglutinin__InfluenzaA__ADV69090
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagagccugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccagaaagaacggccuguaccccaaccugagcaagagcuacgccaacaacaaggagaaggaggugcuggugcuguggggcgugcaccacccccccaaccugggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 158870 - RNA, 1698 nt, Artificial Sequence
  derived and/or modified sequence opt4 from hemagglutinin__InfluenzaA__ADV69091
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcaacguggccggcuggauccugggcaaccccgagugcgagcugcugaucagcaaggagagcuggagcuacaucguggagacccccaaccccgagaacggcaccugcuaccccggcuacuucaccgacuacgaggagcugagagagcagcugagcagcgugagcagcuucaagagauucgagaucuuccccaaggagagcagcuggcccaaccacaccgugaccggcgugagcgccagcugcagccacaacggcaagagcagcuucuacagaaaccugcuguggcugaccagaaagaacggccuguaccccaaccugagcaagagcuacaccaacgacaaggagaaggaggugcuggugcuguggggcgugcaccaccccagcaacaucggcgaccagagagcccuguaccacaaggagaacgccuacgugagcguggugagcagccacuacagcagaagauucacccccgagaucgugaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaccagcaacgcccccauggacgagugcaacaccaagugccagaccccccagggcgccaucaacagcagccugcccuuccagaacgugcaccccgugaccaucggcgagugccccaaguacgugaagagcgccaagcugagaauggugaccggccugagaaacacccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagaaccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcauggagguguaccagauccuggccaucuacagcaccguggccagcagccugguguuccuggugagccugggcgccaucugcuucuggaugugcagcaacggcagccugcagugcagaaucugcaucuga

SEQ ID NO: 158871 - RNA, 1698 nt, Artificial Sequence
  derived and/or modified sequence opt4 from hemagglutinin__InfluenzaA__ADV69092
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcaacguggccggcuggauccugggcaaccccgagugcgagcugcugaucagcaaggagagcuggagcuacaucguggagacccccaaccccgagaacggcaccugcuaccccggcuacuucaccgacuacgaggagcugagagagcagcugagcagcgugagcagcuucaagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacaccaacgacaaggagaaggaggugcuggugcuguggggcgugcaccaccccagcaacaucggcgaccagagagcccuguaccacaaggagaacgccuacgugagcguggugagcagccacuacagcagaagauucacccccgagaucgugaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaccagcaacgcccccauggacgagugcaacaccaagugccagaccccccagggcgccaucaacagcagccugcccuuccagaacgugcaccccgugaccaucggcgagugccccaaguacgugaagagcgccaagcugagaauggugaccggccugagaaacacccugagcauccagagcaagggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcauggagguguaccagauccuggccaucuacagcaccguggccagcagccugguguuccuggugagccugggcgccaucugcuucuggaugugcagcaacggcagccugcagugcagaaucugcaucuga

SEQ ID NO: 158872 - RNA, 1698 nt, Artificial Sequence
  derived and/or modified sequence opt4 from hemagglutinin__InfluenzaA__ADV69093
augaaggugaagcugauggugcugcugugcaccuucaccgccaccuacgccgacaccaucugcgugggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcagcugcagcguggccggcuggauccugggcaaccccgagugcgagcugcugaucagcaaggagagcuggagcuacaucguggagacccccaaccccgagaacggcaccugcuaccccggcuacgugaccgacuacgaggagcugagagagcagcugagcagcgugagcagcuucaagagauucgagaucuuccccaaggagagcagcuggcccaaccacaccgugaccggcgugagcagcagcugcagccacaacggcaagagcagcuucuacagaaaccugcuguggcugaccgugaagaacggccuguaccccaaccugagcaagagcuacaccaacaagaaggagaaggaggugcuggugcuguggggcgugcaccaccccagcaacaucggcgaccagagagcccuguaccacaccgagaacgccuacgugagcguggugagcagccacuacagcagaagauucacccccgagaucgccaagagacccaaggugagaaaccaggagggcagaaucaacuacuacuggacccugcuggagcccggcgacaccaucaucuucgaggccaacggcaaccugaucgcccccagauacgccuucgagcugagcaagggcuucggcagcggcaucaucaccagcaacgcccccaugggcgagugcaacgccaagugccagaccccccagggcgccaucaacagcagccugcccuuccagaacgugcaccccgugaccaucggcgagugccccaaguacgugaagagcgccaagcugagaauggugaccggccugagaaacacccccagcauccagagcagaggccuguucggcgccaucgccggcuucaucgagggcggcuggaccggcaugguggacggcugguacggcuaccaccaccagaacgagcagggcagcggcuacgccgccgaccagcagagcacccagaacgccaucaacggcaucaccaacaaggugaacagcgugaucgagaagaugaacacccaguucaccgccgugggcaaggaguucaacaagcuggagagaagaauggagaaccugaacaagagaguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguacaacauccuggccaucuacagcaccguggccagcagccuggugcugcuggugagccugggcgccaucagcuucuggaugugcagcaacggcagccugcagugcagaaucugcaucuga

SEQ ID NO: 158873 - RNA, 1698 nt, Artificial Sequence
  derived and/or modified sequence opt4 from hemagglutinin__InfluenzaA__ADV69094
augaaggugaagcugauggugcugcugugcaccuucaccgccaccuacgccgacaccaucugcgugggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcagcugcagcguggccggcuggauccugggcaaccccgagugcgagcugcugaucagcaaggagagcuggagcuacaucguggagacccccaaccccgagaacggcaccugcuaccccggcuacuucaccgacuacgaggagcugagagagcagcugagcagcgugagcagcuucaagagauucgagaucuuccccaaggagagcagcuggcccaaccacaccgugaccggcgugagcagcagcugcagccacaacggcaagagcagcuucuacagaaaccugcuguggcugaccgugaagaacggccuguaccccaaccugagcaagagcuacaccaacaagaaggagaaggaggugcuggugcuguggggcgugcaccaccccagcaacaucggcgaccagagagcccuguaccacaccgagaacgccuacgugagcguggugagcagccacuacagcagaagauucacccccgagaucgccaagagacccaaggugagaaaccaggagggcagaaucaacuacuacuggacccugcuggagcccggcgacaccaucaucuucgaggccaacggcaaccugaucgcccccagauacgccuucgagcugagcaagggcuucggcagcggcaucaucaccagcaacgcccccaugggcgagugcaacgccaagugccagaccccccagggcgccaucaacagcagccugcccuuccagaacgugcaccccgugaccaucggcgagugccccaaguacgugaagagcgccaagcugagaauggugaccggccugagaaacacccccagcauccagagcagaggccuguucggcgccaucgccggcuucaucgagggcggcuggaccggcauggugcacggcugguacggcuaccaccaccagaacgagcagggcagcggcuacgccgccgagcagcagagcacccaguacgccaucaacggcaucaccaacaaggugaacagcgugaucgagaagaugaacacccaguucaccgccgugggcaaggaguucaacaagcuggagagaagaauggagaaccugaacaagagaguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguacaacauccuggccaucuacagcaccguggccagcagccuggugcugcuggugagccugggcgccaucagcuucuggaugugcagcaacggcagccugcagugcagaaucugcaucuga

SEQ ID NO: 158874 - RNA, 1698 nt, Artificial Sequence
  derived and/or modified sequence opt4 from hemagglutinin__InfluenzaA__ADV69095
augaaggugaagcugauggugcugcugugcaccuucaccgccaccuacgccgacaccaucugcgugggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcagcugcagcguggccggcuggauccugggcaaccccgagugcgagcugcugaucagcaaggagagcuggagcuacaucguggagccccccaaccccgagaacggcaccugcuaccccggcuacuucaccgacuacgaggagcugagagagcagcugagcagcgugagcagcuucaagagauucgagaucuuccccaaggagagcagcuggcccaaccacaccgugaacggcgugagcagcagcugcagccacaacggcgagagcagcuucuacagaaaccugcuguggcugaccgugaaggacggccuguaccccaaccugagcaagagcuacaccaacaagaaggagaaggaggugcuggugcuguggggcgugcaccaccccagcaacaucggcgaccagagagcccuguaccacaccgagaacgccuacgugagcguggugagcagccacuacagcagaagauucacccccgagaucgccaagagacccaaggugagaaaccaggagggcagaaucaacuacuacuggacccugcuggagcccggcgacaccaucaucuucgaggccaacggcaaccugaucgcccccagauacgccuucgagcugagcaagggcuucggcagcggcaucaucaccagcaacgcccccaugggcgagugcaacgccaagugccagaccccccagggcgccaucaacagcagccugcccuuccagaacgugcaccccgugaccaucggcgagugccccaaguacgugagaagcaccaagcugagaauggugaccggccugagaaacacccccagcauccagagcagaggccuguucggcgccaucgccggcuucaucgagggcggcuggaccggcaugguggacggcugguacggcuaccaccaccagaacgagcagggcagcggcuacgccgccgaccagcagagcacccagaacgccaucaacggcaucaccaacaaggugaacagcgugaucgagaagaugaacacccaguucaccgccgugggcaaggaguucaacaagcuggagagaagaauggagaaccugaacaagaagaucgacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguacaacauccuggccaucuacagcaccguggccagcagccuggugcugcuggugagccugggcgccaucagcuucuggaugugcagcaacggcagccugcagugcagaaucugcaucuga

SEQ ID NO: 158875 - RNA, 1698 nt, Artificial Sequence
  derived and/or modified sequence opt4 from hemagglutinin__InfluenzaA__ADV69096
augaaggugaagcugauggugcugcugugcaccuucaccgccaccuacgccgacaccaucugcgugggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcagcugcagcguggccggcuggauccugggcaaccccgagugcgagcugcugaucagcaaggagagcuggagcuacaucguggagacccccaaccccgagaacggcaccugcuaccccggcuacgugaccgacuacgaggagcugagagagcagcugagcagcgugagcagcuucaagagauucgagaucuuccccaaggagagcagcuggcccaaccacaccgugaccggcgugagcagcagcugcagccacaacggcaagagcagcuucuacagaaaccugcuguggcugaccgugaagaacggccuguaccccaaccugagcaagagcuacaccaacaagaaggagaaggaggugcuggugcuguggggcgugcaccaccccagcaacaucggcgaccagagagcccuguaccacaccgagaacgccuacgugagcguggugagcagccacuacagcagaagauucacccccgagaucgccaagagacccaaggugagaaaccaggagggcagaaucaacuacuacuggacccugcuggagcccggcgacaccaucaucuucgaggccaacggcaaccugaucgcccccagauacgccuucgagcugagcaagggcuucggcagcggcaucaucaccagcaacgcccccaugggcgagugcaacgccaagugccagacccccaagggcgccaucaacagcagccugcccuuccagaacgugcaccccgugaccaucggcgagugccccaaguacgugaagagcgccaagcugagaauggugaccggccugagaaacacccccagcauccagagcagaggccuguucggcgccaucgccggcuucaucgagggcggcuggaccggcaugguggacggcugguacggcuaccaccaccagaacgagcagggcagcggcuacgccgccgaccagcagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgagagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguacaacauccuggccaucuacagcaccguggccagcagccuggugcugcuggugagccugggcgccaucagcuucuggaugugcagcaacggcagccugcagugcagaaucugcaucuga

SEQ ID NO: 158876 - RNA, 1698 nt, Artificial Sequence
  derived and/or modified sequence opt4 from hemagglutinin__InfluenzaA__ADV69097
augaaggugaagcugcugauccugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaagaagagcuggagcuacaucguggagacccccaaccccggcaacggcgccugcuaccccggcuacuucgccgacuacgaggagcugagagagcagcugagcagcgugagcagcuucgagagauucgagaucuuccccaaggagagcagcuggagcaaccacaacgugaacggcgugagcgccagcugcagccacaacggcaagagcagcuucuacagaaaccugcuguggcugaccggcaagaacggccuguaccccacccugaccaagagcuacgccaacgacaaggagaaggaggugcugauccuguggggcgugcaccaccccagcaacaucggcgaccagagaacccuguaccacaccgagaacgccuacgugagcgugaugagcagccacuacagcagaagauucacccccgagaucagcaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccauggacgagugcgacgccaagugccagaccccccagggcgccaucaacagcagccugcccuuccagaacauccaccccgugaccaucggcgagugccccaaguacgugagaagcgccaagcugagaauggugaccggccugagaaacacccccagcauccagagcagaggccuguucggcgccaucgccggcuucaucgagggcggcuggaccggcaugguggacggcugguacggcuaccaccaccagaacgagcagggcagcggcuacgccgccgaccaggagagcacccagaacgccaucaacgagaucaccaacaaggagaacagcgugaucgagaagaugaacacccaguucaccagcgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagagccuguacgagaaggugaagauccagcugaagaacaacgccaaggagaucggcaacggcugcuucgaguucuaccacaagugcaacaacgagugcauggagagcgugagaaacggcaccuacgacuaccccaaguacagcgaggagagcaagcugaacagagagaagaucgacggcgugaagcuggacagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 158877 - RNA, 1698 nt, Artificial Sequence
  derived and/or modified sequence opt4 from hemagglutinin__InfluenzaA__ADV69098
augaaggugaagcugaucgugcugcugugcaccuucaccgccaccuacgccgacaccaucugcgugggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcagcugcagcguggccggcuggauccugggcaaccccgagugcgagcugcugaucagcaaggagagcuggagcuacaucguggagacccccaaccccgagaacggcaccugcuaccccggcuacuucaccgacuacgaggagcugagagagcagcugagcagcgugagcagcuucaagagauucgagaucuuccccaaggagagcagcuggcccaaccacaccgugaccggcgugagcagcagcugcagccacaacggcaacagcagcuucuacagaaaccugcuguggcugaccgugaagaacggccuguaccccaaccugagcaagagcuacaccaacaagaaggagaaggaggugcuggugcuguggggcgugcaccaccccagcaacaucgaggaccagagagcccuguaccacaccgagaacgccuacgugagcguggugagcagccacuacagcagaagauucaaccccgagaucgccaagagacccaaggugagaaaccaggagggcagaaucaacuacuacuggacccugcuggagcccggcgacaccaucaucuucgaggccaacggcaaccugaucgcccccagauacgccuucgagcugagcaagggcuucggcagcggcaucaucaccagcaacgcccccaugggcgagugcaacgccaagugccagaccccccagggcgccaucaacagcaaccugcccuuccagaacgugcaccccgugaccaucggcgagugccccaaguacgugagaagcgccaagcugagaauggugaccggccugagaaacacccccagcauccagagcagaggccuguucggcgccaucgccggcuucaucgagggcggcuggaccggcaugguggacggcugguacggcuaccaccaccacaacgagcagggcagcggcuacgccgccaaccagaagagcacccccaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugagaagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguacaacauccuggccaucuacagcaccguggccagcagccuggugcugcuggugagccugggcgccaucagcuucuggaugugcagcaacggcagccugcagugcagaaucugcaucuga

SEQ ID NO: 158878 - RNA, 1698 nt, Artificial Sequence
  derived and/or modified sequence opt4 from hemagglutinin__InfluenzaA__ADV69099
augaaggugaagcugaucgugcugcugugcaccuucaccgccaccuacgccgacaccaucugcgugggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcagcugcagcguggccggcuggauccugggcaaccccgagugcgagcugcugaucagcaaggagagcuggagcuacaucguggagacccccaaccccgagaacggcaccugcuaccccggcuacuucaccgacuacgaggagcugagagagcagcugagcagcgugagcagcuucaagagauucgagaucuuccccaaggagagcagcuggcccaaccacaccgugaccggcgugagcagcagcugcagccacaacggcaacagcagcuucuacagaaaccugcuguggcugaccgugaagaacggccuguaccccaaccugagcaagagcuacaccaacaagaaggagaaggaggugcuggugcuguggggcgugcaccaccccagcaacaucgaggaccagagagcccuguaccacaccgagaacgccuacgugagcguggugagcagccacuacagcagaagauucaaccccgagaucgccaagagacccaaggugagaaaccaggagggcagaaucaacuacuacuggacccugcuggagcccggcgacaccaucaucuucgaggccaacggcaaccugaucgcccccagauacgccuucgagcugagcaagggcuucggcagcggcaucaucaccagcaacgcccccaugggcgagugcaacgccaagugccagaccccccagggcgccaucaacagcaaccugcccuuccagaacgugcaccccgugaccaucggcgagugccccaaguacgugagaagcgccaagcugagaauggugaccggccugagaaacacccccagcauccagagcagaggccuguucggcgccaucgccggcuucaucgagggcggcuggaccggcauggugaacggcugguacggcuaccaccaccacaacgagcagggcagcggcuacgccgccaaccagcagagcccccccaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugagaagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguacaacauccuggccaucuacagcaccguggccagcagccuggugcugcuggugagccugggcgccaucagcuucuggaugugcagcaacggcagccugcagugcagaaucugcaucuga

SEQ ID NO: 158879 - RNA, 1698 nt, Artificial Sequence
  derived and/or modified sequence opt4 from hemagglutinin__InfluenzaA__ADV69100
augaaggugaagcugcugauccugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagagccugaucagcaagaagagcuggagcuacaucguggagacccccaagcccgagaacggcaccugcuaccccggcgaguucgccgacuacgaggagcugagagagcagcugagcagcgugagcagcuucgagagauucgagaucuuccccaaggagagcagcuggcccaaccacaccgccgccggcgugagcgccagcugcagccacaacggcgagagaagcuucuacaagaaccugaucuggcugaccgugaagaacggccuguaccccaaccugagcaagagcuacaagaacgacaaggagaaggaggugcugauccuguggggcgugcaccacccccccaacaucgagaaccagagaacccuguaccacaccgagaacaccuacgugagcguggugagcagccacuacagcggcagauucacccccgagaucaccaagagacccaaggugagagaccaggagggcagaaucaacuacuacuggacccugcuggagcccggcgacaccaucaucuucgaggccaacggcaaccugaucgcccccugguacgccuucacccugagcagaggccugggcagcggcaucgugaccagcaacgcccccauggacaagugcgacgccaagugccagaccccccacggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccaggagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagagccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggacagcaugggcguguacagaauccuggccaucuacagcaccguggccagcagccuggugcugcuggugagccugggcgccaucagcuucuggaugugcagcaacggcagccugcagugcagaaucugcaucuga

SEQ ID NO: 158880 - RNA, 1698 nt, Artificial Sequence
  derived and/or modified sequence opt4 from hemagglutinin__InfluenzaA__ADV69101
augaaggugaagcugcugauccuguucugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagagccugaucagcaagaagagcuggagcuacaucguggagacccccaaccccgagaacggcgccugcuaccccggcgaguucgccgacuacgaggagcugagagagcagcugagcagcgugagcagcuucgagagauucgagaucuuccccaaggagagcagcuggcccaaccacaccgccaccggcgugagcgccagcugcagccacaacggcgagagaagcuucuacagaaaccugaucuggcugaccgugaagaacggccuguaccccaaccugagcaagagcuacgagaacgacaaggagaaggaggugcugauccuguggggcgugcaccacccccccaacaucgagaaccagagaacccuguaccacaccgagaacgccuacgugagcguggugagcagccacuacagcggcagauucacccccgagaucaccaagagacccaaggugagagaccaggagggcagaaucaacuacuacuggacccugcuggagcccggcgacaccaucaucuucgaggccaacggcaaccugaucgcccccugguacgccuucacccugagcagaggccugggcagcggcaucaucaccagcaacgcccccauggacgagugcgacagcaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccaggagagcacccagaacgccaucaacggcaucaccaacaaggugaacagcgugaucgagaagaugaacccccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagagccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggacagcaugggcguguacagaauccuggccaucuacagcaccguggccagcagccuggugcugcuggugagccugggcgccaucagcuucuggaugugcagcaacggcagccugcagugcagaaucugcaucuga

SEQ ID NO: 158881 - RNA, 1698 nt, Artificial Sequence
  derived and/or modified sequence opt4 from hemagglutinin__InfluenzaA__ADV69102
augaaggugaagcugcugauccuguucugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagagccugaucagcaagaagagcuggagcuacaucguggagacccccaaccccgagaacggcgccugcuaccccggcgaguucgccgacuacgaggagcugagagagcagcugagcagcgugagcagcuucgagagauucgagaucuuccccaaggagagcagcuggcccaaccacaccgccaccggcgugagcgccagcugcagccacaacggcgagagaagcuucuacagaaaccugaucuggcugaccgugaagaacggccuguaccccaaccugagcaagagcuacgagaacgacaaggagaaggaggugcugauccuguggggcgugcaccacccccccaacaucgagaaccagagaacccuguaccacaccgagaacgccuacgugagcguggugagcagccacuacagcggcagauucacccccgagaucaccaagagacccaaggugagagaccaggagggcagaaucaacuacuacuggacccugcuggagcccggcgacaccaucaucuucgaggccaacggcaaccugaucgcccccugguacgccuucacccugagcaccggccugggcagcggcaucaucaccagcaacgcccccauggacgagugcgacagcaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccaggagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagagccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggacagcaugggcguguacagaauccuggccaucuacagcaccguggccagcagccuggugcugcuggugagccugggcgccaucagcuucuggaugugcagcaacggcagccugcagugcagaaucugcaucuga

SEQ ID NO: 158882 - RNA, 1698 nt, Artificial Sequence
  derived and/or modified sequence opt4 from hemagglutinin__InfluenzaA__ADV69103
augaaggugaagcugauggugcugcugugcaccuucaccgccaccuacgccgacaccaucugcgugggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcagcugcagcguggccggcuggauccugggcaaccccgagugcgagcugcugaucagcaaggagagcuggagcuacaucguggagacccccaaccccgagaacggcaccugcuaccccggcuacuucaccgacuacgaggagcugagagagcagcugagcagcgugagcagcuucaagagauucgagaucuuccccaaggagagcagcuggcccaaccacaacgugaccggcgugagcagcagcugcagccacaacggcaagagcagcuucuacagaaaccugcuguggcugaccgugaagaacggccuguaccccaaccugagcaagagcuacaccaacaagaaggagaaggaggugcuggugcuguggggcgugcaccaccccagcaacaucggcgaccagagagcccuguaccacaccgagaacgccuacgugagcguggugagcagccacuacagcagaagauucacccccgagaucgccaagagacccaaggugagaaaccaggagggcagaaucaacuacuacuggacccugcuggagcccggcgacaccaucaucuucgaggccaacggcaaccugaucgcccccagauacgccuucgagcugagcaagggcuucggcagcggcaucaucaccagcaacgcccccaucggcgagugcaacgccaagugccagaccccccagggcgccaucaacagcagccugcccuuccagaacgugaaccccgugaccaucggcgagugccccaaguacgugaagagcgccaagcugagaauggugaccggccugagaaacacccccagcauccagagcagaggccuguucggcgccaucgccggcuucaucgagggcggcuggaccggcaugguggacggcugguacggcuaccaccaccagaacgagcagggcagcggcuacgccgccgaccagcagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguacaacauccuggccaucuacagcaccguggccagcagccuggugcugcuggugagccugggcgccaucagcuucuggaugugcagcaacggcagccugcagugcagaaucugcaucuga

SEQ ID NO: 158883 - RNA, 1698 nt, Artificial Sequence
  derived and/or modified sequence opt4 from hemagglutinin__InfluenzaA__ADV69104
augaaggugaagcugcugauccuguucugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagagccugaucagcaagaagagcuggagcuacaucguggagacccccaaccccgagaacggcgccugcuaccccggcgaguucgccgacuacgaggagcugagagagcagcugagcagcgugagcagcuucgagagauucgagaucuuccccaaggagagcagcuggcccaaccacaccgccaccggcgugagcgccagcugcagccacaacggcgagagaagcuucuacagaaaccugaucuggcugaccgugaagaacggccuguaccccaaccugagcaagagcuacgagaacgacaaggagaaggaggugcugauccuguggggcgugcaccacccccccaacaucgagaaccagagaacccuguaccacaccgagaacgccuacgugagcguggugagcagccacuacagcggcagauucacccccgagaucaccaagagacccaaggugagagaccaggagggcagaaucaacuacuacuggacccugcuggagcccggcgacaccaucaucuucgaggccaacggcaaccugaucgcccccugguacgccuucacccugagcagaggccugggcagcggcaucaucaccagcaacgcccccauggacgagugcgacagcaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccaggagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagagccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggacagcaugggcguguacagaauccuggccaucuacagcaccguggccagcagccuggugcugcuggugagccugggcgccaucagcuucuggaugugcagcaacggcagccugcagugcagaaucugcaucuga

SEQ ID NO: 158884 - RNA, 1698 nt, Artificial Sequence
  derived and/or modified sequence opt4 from hemagglutinin__InfluenzaA__ADV69105
augaaggugaagcugcugauccugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagagccugaucagcaagaagagcuggagcuacaucguggagacccccaaccccgagaacggcgccugcuaccccggcgaguucgccgacuacgaggagcugagagagcagcugagcagcgugagcagcuucgagagauucgagaucuuccccaaggagagcagcuggcccaaccacaccgccgccggcgugagcgccagcugcagccacaacggcgagagaagcuucuacagaaaccugaucuggcugaccgugaagaacggccuguaccccaaccugagcaagagcuacaagaacgacaaggagaaggaggugcugaucaucuggggcgugcaccacccccccaacaucgagaaccagagaacccuguaccacaccgagaacgccuacgugagcguggugagcagccacuacagcggcagauucacccccgagaucaccaagagacccaaggugagagaccaggagggcagaaucaacuacuacuggacccugcuggagcccggcgacaccaucaucuucgaggccaacggcaaccugaucgcccccugguacgccuucacccugagcagaggccugggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccaggagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagagccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggacagcaugggcguguacagaauccuggccaucuacagcaccguggccagcagccuggugcugcuggugagccugggcgccaucagcuucuggaugugcagcaacggcagccugcagugcagaaucugcaucuga

SEQ ID NO: 158885 - RNA, 1698 nt, Artificial Sequence
  derived and/or modified sequence opt4 from hemagglutinin__InfluenzaA__ADV69106
augaaggugaagcugcugauccugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagagccugaucagcaagaagagcuggagcuacaucguggagacccccaaccccggcaacggcgccugcuaccccggcuacuucgccgacuacgaggagcugagagagcagcugagcagcgugagcagcuucgagagauucgagauguuccccaaggagagcagcuggcccaaccacaacgugaacggcgugagcgccagcugcagccacaacggcaagagcagcuucuacagaaaccugcuguggcugaccagaaagaacggccuguaccccaaccugaccaagagcuacgccaacaacaacgacaaggaggugcugauccuguggggcgugcaccaccccagcaacaucggcgaccagagaacccuguaccacaccgagaacgccuacgugagcgugaugagcagccacuacagcagaagauucacccccgagaucaccaagagacccaaggugagagaccaggagggcagaaucaacuacuacuggacccugcuggagcccggcgacaccaucaucuucgaggccaacggcaaccugaucgcccccugguacgccuucgcccugagcagaagcuucggcagcggcaucaucaccagcagcgcccccauggacgagugcgacgccaagugccagaccccccagggcgccaucaacagcagccugcccuuccagaacgugcaccccgugaccaucggcgagugccccaaguacgugagaagcgccaagcugaagauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccaggagagcacccagaacgccaucaacggcaucaccaacaaggugaacagcgugaucgagaagaugaacacccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagagccuguacgagaaggugaagauccagcugaagaacaacgccaaggagaucggcaacggcugcuucgaguucuaccacaagugcaacaacgagugcauggagagcgugagaaacggcaccuacgacuaccccaaguacagcgaggagagcaagcugaacagagagaagaucgacggcgugaagcuggacagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 158886 - RNA, 1698 nt, Artificial Sequence
  derived and/or modified sequence opt4 from hemagglutinin__InfluenzaA__ADV69107
augaaggugaagcugcugauccugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagagccugaucagcaaggagagcuggagcuacaucguggagacccccaacagcgacaacggcgccugcuaccccggccaguucaccgacuacgaggagcugagagagcagcugagcagcgugagcagcuucgagagauucgagaucuuccccaaggagagcagcuggcccaaccacaccgugaccggcgugagcgccagcugcagccacaacggcgagagaagcuucuacagaaaccugaucuggcugaccgugaagaacggccuguaccccaaccugagcaagagcuacgagaacgacaaggagaaggaggugcugauccuguggggcgugcaccacccccccaacaucggcgaccagagaacccuguaccacaccgagaacgccuacaucagcguggugagcagccacuacagcggcagauucacccccgagaucaccaagagacccaaggugagagaccaggagggcagaaucaacuacuacuggacccugcuggagcccggcgacaccaucaucuucgaggccaacggcaaccugaucgcccccugguacgccuucgcccugagcagaggccugggcagcggcaucaucaccagcaacgcccccauggacaagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccaggagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagagccuguacgagaaggugaagagccagcugaagaacaacgccaaggagaucggcaacggcugcuucgaguucuaccacaagugcaacaacgagugcauggagagcgugagaaacggcaccuacgacuaccccaaguacagcgaggagagcaagcugaacagagagaagaucgacggcgugaagcuggacagcaugggcguguacagaauccuggccaucuacagcaccgccgccagcagccuggugcugcuggugagccugggcgccaucagcuucuggaugugcagcaacggcagccugcagugcagaaucugcaucuga

SEQ ID NO: 158887 - RNA, 1698 nt, Artificial Sequence
  derived and/or modified sequence opt4 from hemagglutinin__InfluenzaA__ADV69108
augaaggugaagcugcuggugcugcugugcaccuucaccgccaccuacgccgacaccaucugcgugggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcagcugcagcguggccggcuggauccugggcaaccccgagugcgagcugcugaucagcaaggagagcuggagcuacaucguggagacccccaaccccgagaacggcaccugcuaccccggcuacuucaccgacuacgaggagcugagagagcagcugagcagcgugagcagcuucaagagauucgagaucuuccccaaggagagcagcuggcccaaccacaccgugaccggcgugagcagcagcugcagccacaacggcaagagcagcuucuacagaaaccugcuguggcugaccaugaagaacggccuguaccccaaccugagcaagagcuacaccaacaagaaggagaaggaggugcuggugcuguggggcgugcaccaccccagcaacaucggcgaccagagagcccuguaccacaccgagaacgccuacgugagcguggugagcagccacuacagcagaagauucacccccgagaucgccaagagacccaaggugagaaaccaggagggcagaaucaacuacuacuggacccugcuggagcccgaggacaccaucaucuucgaggccaacggcaaccugaucgcccccagauacgccuucgagcugagcaagggcuucggcagcggcaucaucaccagcaacgcccccaugggcgagugcaacgccaagugccagaccccccagggcgccaucaacagcagccugcccuuccagaacgugcaccccgugaccaucggcgagugccccaaguacgugagaagcagcaagcugagaauggugaccggccugagaaacacccccagcauccagagcagaggccuguucggcgccaucgccggcuucaucgagggcggcuggaccggcaugguggacggcugguacggcuaccaccaccagaacgagcagggcagcggcuacgccgccgaccagcagagcacccagaacgccaucaacggcaucaccaacaaggugaacagcgugaucgagaagaugaacacccaguucaccgccgugggcaaggaguucaacaagcuggagagaagaauggagaaccugaacaagaagaucgacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguacaacauccuggccaucuacagcaccguggccagcagccuggugcugcuggugagccugggcgccaucagcuucuggaugugcagcaacggcagccugcagugcagaaucugcaucuga

SEQ ID NO: 158888 - RNA, 1698 nt, Artificial Sequence
  derived and/or modified sequence opt4 from hemagglutinin__InfluenzaA__ADV69109
augaaggugaagcugcugauccugcugugcaccuucaaggccaccuacgccgacaccaucugcaucggcuaccacgccaacaacagcaccgagaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagagccugaucagcaagaagagcuggagcuacaucguggagacccccaaccccgagaacggcgccugcuaccccggcgaguucgccgacuacgaggagcugagagagcagcugagcagcgugagcagcuucgagagauucgagaucuuccccaaggagagcagcuggcccaaccacaccgccaccggcgugagcgccagcugcagccacaacggcgagagaagcuucuacagaaaccugaucuggcugaccgugaagaacggccuguaccccaaccugagcaagagcuacgagaacgacaagaagaaggaggugcugauccuguggggcgugcaccacccccccaacaucgagaaccagagaacccuguaccacaccgagaacgccuacgugagcguggugagcagccacuacagcggcagauucacccccgagaucaccaagagacccaaggugagagaccaggagggcagaaucaacuacuacuggacccugcuggagcccggcgacaccaucaucuucgaggccaacggcaaccugaucgcccccugguacgccuucacccugagcagaggccugggcagcggcaucaucaccagcaacgcccccauggacgagugcgacgccaagugccagacccccaagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccaggagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagagccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggacagcaugggcguguacagaauccuggccaucuacagcaccguggccagcagccuggugcugcuggugagccugggcgccaucagcuucuggaugugcagcaacggcagccugcagugcagaaucugcaucuga

SEQ ID NO: 158889 - RNA, 1701 nt, Artificial Sequence
  derived and/or modified sequence opt4 from hemagglutinin__InfluenzaA__ADV76579
augaagaccaucaucgcccugagcuacauccugugccugguguucgcccagaagcugcccggcaacgacgacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugagauucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 158890 - RNA, 1701 nt, Artificial Sequence; identical to SEQ ID NO: 156108
  derived and/or modified sequence opt4 from hemagglutinin__InfluenzaA__ADV76587

SEQ ID NO: 158891 - RNA, 1701 nt, Artificial Sequence; identical to SEQ ID NO: 156108
  derived and/or modified sequence opt4 from hemagglutinin__InfluenzaA__ADV76598

SEQ ID NO: 158892 - RNA, 1701 nt, Artificial Sequence; identical to SEQ ID NO: 155931
  derived and/or modified sequence opt4 from hemagglutinin__InfluenzaA__ADV76609

SEQ ID NO: 158893 - RNA, 1701 nt, Artificial Sequence; identical to SEQ ID NO: 156108
  derived and/or modified sequence opt4 from hemagglutinin__InfluenzaA__ADV76620

SEQ ID NO: 158894 - RNA, 1701 nt, Artificial Sequence
  derived and/or modified sequence opt4 from hemagglutinin__InfluenzaA__ADV76631
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgugauccccaacaucggcagcagacccagagugagaaacauccccagcagaaucagcaucuacuggaccauggugaagcccggcgacauccugcugaucaacagcaccggcaaccugaucgcccccagaggcuacuucaagaucagaagcggcaagagcagcaucaugagaagcgacacccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaaggccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 158895 - RNA, 1701 nt, Artificial Sequence; identical to SEQ ID NO: 158112
  derived and/or modified sequence opt4 from hemagglutinin__InfluenzaA__ADV76642

SEQ ID NO: 158896 - RNA, 1701 nt, Artificial Sequence; identical to SEQ ID NO: 158116
  derived and/or modified sequence opt4 from hemagglutinin__InfluenzaA__ADV76664

SEQ ID NO: 158897 - RNA, 1701 nt, Artificial Sequence
  derived and/or modified sequence opt4 from hemagglutinin__InfluenzaA__ADV76673
augaagaccaucaucgcccugagcuacaucuucugccuggcccugggccaggaccugcccggcaacgacaacagcaccgccacccugugccugggccaccacgccgugcccaacggcacccuggugaagaccaucaccgacgaccagaucgaggugaccaacgccaccgagcuggugcagagcagcagcaccggcaagaucugcaacaacccccacagaauccuggacggcaucgacugcacccugaucgacgcccugcugggcgacccccacugcgacguguuccagaacgagaccugggaccuguucguggagagaagcaaggccuucagcaacugcuaccccuacgacgugcccgacuacgccagccugagaagccugguggccagcagcggcacccuggaguucaucaccgagggcuucaccuggaccggcgugacccagaacggcggcagcaacgccugcaagagaggccccggcagcggcuucuucagcagacugaacuggcugaccaagagcggcagcaccuaccccgugcugaacgugaccaugcccaacaacgacaacuucgacaagcuguacaucuggggcgugcaccaccccagcaccaaccaggagcagaccagccuguacgugcaggccagcggcagagugaccgugagcaccagaagaagccagcagaccaucauccccaacaucgagagcagacccugggugagaggccugagcagcagaaucagcaucuacuggaccaucgugaaccccggcgacgugcuggugaucaacagcaacggcaaccugaucgcccccagaggcuacuucaagaugagaaccggcaagagcagcaucaugagaagcgacgcccccaucgacaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggccuguucggcgccaaggccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucgagagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagagaggcaacaucagaugcaacaucugcaucuga

SEQ ID NO: 158898 - RNA, 1701 nt, Artificial Sequence
  derived and/or modified sequence opt4 from hemagglutinin__InfluenzaA__ADV76682
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcgagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 158899 - RNA, 1701 nt, Artificial Sequence; identical to SEQ ID NO: 156133
  derived and/or modified sequence opt4 from hemagglutinin__InfluenzaA__ADV76694

SEQ ID NO: 158900 - RNA, 1701 nt, Artificial Sequence; identical to SEQ ID NO: 155931
  derived and/or modified sequence opt4 from hemagglutinin__InfluenzaA__ADV76705

SEQ ID NO: 158901 - RNA, 1701 nt, Artificial Sequence; identical to SEQ ID NO: 156133
  derived and/or modified sequence opt4 from hemagglutinin__InfluenzaA__ADV76716

SEQ ID NO: 158902 - RNA, 1701 nt, Artificial Sequence
  derived and/or modified sequence opt4 from hemagglutinin__InfluenzaA__ADV76727
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaagagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 158903 - RNA, 1701 nt, Artificial Sequence
  derived and/or modified sequence opt4 from hemagglutinin__InfluenzaA__ADV91009
augaaggccauccuggccgugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcaucgccccccugcaccugggcaagugcaacaucgccggcuggauccugggcaaccccgagugcgagagccugagcaccgccagcagcuggagcuacaucguggagacccccagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaagaaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacguggagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158904 - RNA, 1701 nt, Artificial Sequence
  derived and/or modified sequence opt4 from hemagglutinin__InfluenzaA__ADV91010
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaccgacuacgaggagcugagagagcagcugagcagcgugagcagcuucgagagauucgagaucuuccccaagaccagcagcuggcccaaccacgacagcaacaagggcgugaccaccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccacccccccaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158905 - RNA, 1701 nt, Artificial Sequence
  derived and/or modified sequence opt4 from hemagglutinin__InfluenzaA__ADW01407
auggaggccaagcuguucgugcuguucugcgccuucaccgcccugaaggccgacaccaucugcgugggcuaccacgccaacaacagcaccgacaccguggacaccauccuggagaagaacgugaccgugacccacagcgugaaccugcuggagaacagccacaacggcaagcugugcagccugaacggcaagaucccccugcagcugggcaacugcaacguggccggcuggauccugggcaaccccaagugcgaccugcugcugaccgccaacagcuggagcuacaucaucgagaccagcaacagcaagaacggcgccugcuaccccggcgaguucgccgacuacgaggagcugaaggagcagcugagcaccgugagcagcuucgagagauucgagaucuuccccaaggccaccagcuggcccaaccacgacaccaccagaggcaccaccguggccugcagccacagcggcgccaacagcuucuacagaaaccugcuguggaucgugaagaagggcaacagcuaccccaagcugagcaagagcuacaccaacaacaagggcaaggaggugcuggugaucuggggcgugcaccacccccccaccgacagcgaccagcagacccuguaccagaacaaccacaccuacgugagcgugggcagcagcaaguacuacaagagacugacccccgagaucguggccagacccaaggugagagagcaggccggcagaaugaacuacuacuggacccugcuggaccagggcgacaccaucaccuucgaggccaccggcaaccugaucgcccccuggcacgccuucgcccugaagaagggcagcagcagcggcaucaugagaagcgacgcccaggugcacaacugcaccaccaagugccagaccccccacggcgcccugaagggcaaccugcccuuccagaacgugcaccccgugaccaucggcgagugccccaaguacgugaagagcacccagcugagaauggccaccggccugagaaacauccccagcauccagagcagaggccuguucggcgccaucgccggcuucaucgagggcggcuggaccggcaugguggacggcugguacggcuaccaccacagaaacgagcagggcagcggcuacgccgccgaccagaagagcacccagaucgccaucgacggcaucagcaacaaggugaacagcgugaucgagaagaugaacauccaguucaccagcgugggcaaggaguucaacagccuggagaagagaauggagaaccugaacaagaagguggacgacggcuuccuggacguguggaccuacaacgccgagcugcugauccugcuggagaacgagagaacccuggacuuccacgaccugaacgugaagaaccuguacgagaaggugaagagccagcugagaaacaacgccaaggagaucggcaacggcugcuucgaguucuaccacaagugcgacaacgagugcauggagagcgugaagaacggcaccuacaacuaccccaaguacagcgaggagagcaagcugaacagagaggagaucgacggcgugaagcuggagagcaugggcauccaccagauccuggccaucuacagcaccguggccagcagccuggugcugcuggugagccugggcgccaucagcuucuggaugugcagcaacggcagccugcagugcagagugugcaucuga

SEQ ID NO: 158906 - RNA, 1698 nt, Artificial Sequence; identical to SEQ ID NO: 155651
  derived and/or modified sequence opt4 from hemagglutinin__InfluenzaA__ADW09101

SEQ ID NO: 158907 - RNA, 1698 nt, Artificial Sequence
  derived and/or modified sequence opt4 from hemagglutinin__InfluenzaA__ADW09111
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucguggaccagaagacccuguacagaaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagacccccagaggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgaccagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 158908 - RNA, 1698 nt, Artificial Sequence
  derived and/or modified sequence opt4 from hemagglutinin__InfluenzaA__ADW09120
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccgugaagaacggccuguaccccaaccugagcaagagcuacgccaacaacaaggagaaggaggugcuggugcuguggggcgugcaccacccccccaacaucguggaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcaagggcuucggcagcggcaucaucaacagcaacgcccccauggacaagugcgacgccaagugccagacccccagaggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 158909 - RNA, 1698 nt, Artificial Sequence; identical to SEQ ID NO: 156136
  derived and/or modified sequence opt4 from hemagglutinin__InfluenzaA__ADW09131

SEQ ID NO: 158910 - RNA, 1698 nt, Artificial Sequence
  derived and/or modified sequence opt4 from hemagglutinin__InfluenzaA__ADW09153
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccgugaagaacggccuguaccccaaccugagcaagagcuacgccaacaacaaggagaaggaggugcuggugcuguggggcgugcaccacccccccaacaucguggaccagaagacccuguacagaaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagacccccagaggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccaggacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 158911 - RNA, 1698 nt, Artificial Sequence; identical to SEQ ID NO: 156136
  derived and/or modified sequence opt4 from hemagglutinin__InfluenzaA__ADW09164

SEQ ID NO: 158912 - RNA, 1698 nt, Artificial Sequence
  derived and/or modified sequence opt4 from hemagglutinin__InfluenzaA__ADW09186
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucguggaccagaagacccuguacagaaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacacccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 158913 - RNA, 1698 nt, Artificial Sequence; identical to SEQ ID NO: 155651
  derived and/or modified sequence opt4 from hemagglutinin__InfluenzaA__ADW09197

SEQ ID NO: 158914 - RNA, 1698 nt, Artificial Sequence; identical to SEQ ID NO: 156136
  derived and/or modified sequence opt4 from hemagglutinin__InfluenzaA__ADW09208

SEQ ID NO: 158915 - RNA, 1698 nt, Artificial Sequence; identical to SEQ ID NO: 156136
  derived and/or modified sequence opt4 from hemagglutinin__InfluenzaA__ADW09219

SEQ ID NO: 158916 - RNA, 1698 nt, Artificial Sequence; identical to SEQ ID NO: 155651
  derived and/or modified sequence opt4 from hemagglutinin__InfluenzaA__ADW09230

SEQ ID NO: 158917 - RNA, 1698 nt, Artificial Sequence
  derived and/or modified sequence opt4 from hemagglutinin__InfluenzaA__ADW09241
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagaugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccgugaagaacggccuguaccccaaccugagcaagagcuacgccaacaacaaggagaaggaggugcuggugcuguggggcgugcaccacccccccaacaucguggaccagaagacccuguacagaaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagacccccagaggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 158918 - RNA, 1698 nt, Artificial Sequence; identical to SEQ ID NO: 156136
  derived and/or modified sequence opt4 from hemagglutinin__InfluenzaA__ADW09252

SEQ ID NO: 158919 - RNA, 1698 nt, Artificial Sequence
  derived and/or modified sequence opt4 from hemagglutinin__InfluenzaA__ADW09274
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccgugaagaacggccuguaccccaaccugagcaagcccuacgccaacaacaaggagaaggaggugcuggugcuguggggcgugcaccacccccccaacaucguggaccagaagacccuguacagaaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagacccccagaggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 158920 - RNA, 1698 nt, Artificial Sequence
  derived and/or modified sequence opt4 from hemagglutinin__InfluenzaA__ADW09285
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucguggaccagaagacccuguacagaaccgagaacgccuacgugagcguggugagcagccacuacagcagaaaguucacccccgagaucgccaagagacccaaggugagagaccaggagggcagaaucaacuacuacuggacccugcuggagcccggcgacaccaucaccuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 158921 - RNA, 1698 nt, Artificial Sequence; identical to SEQ ID NO: 156136
  derived and/or modified sequence opt4 from hemagglutinin__InfluenzaA__ADW09296

SEQ ID NO: 158922 - RNA, 1698 nt, Artificial Sequence; identical to SEQ ID NO: 155651
  derived and/or modified sequence opt4 from hemagglutinin__InfluenzaA__ADW09307

SEQ ID NO: 158923 - RNA, 1698 nt, Artificial Sequence
  derived and/or modified sequence opt4 from hemagglutinin__InfluenzaA__ADW09327
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucguggaccagaagacccuguacagaaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 158924 - RNA, 1698 nt, Artificial Sequence; identical to SEQ ID NO: 156136
  derived and/or modified sequence opt4 from hemagglutinin__InfluenzaA__ADW10483

SEQ ID NO: 158925 - RNA, 1698 nt, Artificial Sequence
  derived and/or modified sequence opt4 from hemagglutinin__InfluenzaA__ADW10494
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucguggaccagaagacccuguacagaaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagaaccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 158926 - RNA, 1698 nt, Artificial Sequence; identical to SEQ ID NO: 156136
  derived and/or modified sequence opt4 from hemagglutinin__InfluenzaA__ADW10505

SEQ ID NO: 158927 - RNA, 1698 nt, Artificial Sequence; identical to SEQ ID NO: 156136
  derived and/or modified sequence opt4 from hemagglutinin__InfluenzaA__ADW10516

SEQ ID NO: 158928 - RNA, 1698 nt, Artificial Sequence
  derived and/or modified sequence opt4 from hemagglutinin__InfluenzaA__ADW10527
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucguggaccagaagacccuguacagaaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggccugggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 158929 - RNA, 1698 nt, Artificial Sequence
  derived and/or modified sequence opt4 from hemagglutinin__InfluenzaA__ADW10538
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucguggaccagaagacccuguacagaaccgagaacgccuacgugagcgugaugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 158930 - RNA, 1698 nt, Artificial Sequence; identical to SEQ ID NO: 156136
  derived and/or modified sequence opt4 from hemagglutinin__InfluenzaA__ADW10549

SEQ ID NO: 158931 - RNA, 1698 nt, Artificial Sequence
  derived and/or modified sequence opt4 from hemagglutinin__InfluenzaA__ADW10560
augaaggugaagcugcuggugcugcugugcaccuucaccgccaccuacgccgacaccaucugcaucggcuaccacgccaacaacagcaccgacaccguggacaccguguucgagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagaagcuucuacagaaaccugcuguggcugaccggcaagaacggccuguaccccaaccugagcaagagcuacgccaacaacaaggagaaggaggugcuggugcuguggggcgugcaccacccccccgacaucggcgaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 158932 - RNA, 1698 nt, Artificial Sequence; identical to SEQ ID NO: 158473
  derived and/or modified sequence opt4 from hemagglutinin__InfluenzaA__ADW10571

SEQ ID NO: 158933 - RNA, 1698 nt, Artificial Sequence; identical to SEQ ID NO: 155651
  derived and/or modified sequence opt4 from hemagglutinin__InfluenzaA__ADW10582

SEQ ID NO: 158934 - RNA, 1698 nt, Artificial Sequence; identical to SEQ ID NO: 156136
  derived and/or modified sequence opt4 from hemagglutinin__InfluenzaA__ADW10593

SEQ ID NO: 158935 - RNA, 1698 nt, Artificial Sequence; identical to SEQ ID NO: 156136
  derived and/or modified sequence opt4 from hemagglutinin__InfluenzaA__ADW10604

SEQ ID NO: 158936 - RNA, 1698 nt, Artificial Sequence; identical to SEQ ID NO: 156136
  derived and/or modified sequence opt4 from hemagglutinin__InfluenzaA__ADW10615

SEQ ID NO: 158937 - RNA, 1698 nt, Artificial Sequence
  derived and/or modified sequence opt4 from hemagglutinin__InfluenzaA__ADW10626
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccgugaagaacggccuguaccccaaccugagcaagagcuacgccaacaacaaggagaaggaggugcuggugcuguggggcgugcaccacccccccagcaucguggaccagaagacccuguacagaaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagacccccagaggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 158938 - RNA, 1698 nt, Artificial Sequence
  derived and/or modified sequence opt4 from hemagglutinin__InfluenzaA__ADW10721
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucaagagauucgagaucuuccccaaggagagcagcuggcccaaccacaccgugaccggcgugagcgccagcugcagccacaacggcgagagcagcuucuacagaaaccugcuguggcugaccgugaagaacggccuguaccccaaccugagcaagagcuacgccaacaacaaggagaaggaggugcuggugcuguggggcgugcaccacccccccaacaucguggaccagagaacccuguaccacaccgagaacgccuacgugagcguggugagcagccacuacagcagaaaguucacccccgagaucgccaagagacccaaggugagaaaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagacccccagaggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 158939 - RNA, 1698 nt, Artificial Sequence
  derived and/or modified sequence opt4 from hemagglutinin__InfluenzaA__ADW10743
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccgugaagaacggccuguaccccaaccugagcaagagcuacgccaacaacaaggagaaggaggugcuggugcuguggggcgugcaccacccccccaacaucguggaccagaagacccuguacagaaccgagaacaccuacgugagcguggugagcagccacuacagcagaaaguucacccccgagaucgccaagagacccaagaucagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagacccccagaggcgccaucaacagcagccugcccuuccagaacgugcaccccgugaccaucggcgagugccccaaguacgugagaagcgugaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 158940 - RNA, 1698 nt, Artificial Sequence
  derived and/or modified sequence opt4 from hemagglutinin__InfluenzaA__ADW10754
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagaacagcuucuacagaaaccugcuguggcugaccggcaagaacggccuguaccccaaccugagcaagagcuacgccaacaacaaggagaaggaggugcuggugcuguggggcgugcaccacccccccaacaucgccgaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcgugcagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 158941 - RNA, 1698 nt, Artificial Sequence
  derived and/or modified sequence opt4 from hemagglutinin__InfluenzaA__ADW10765
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccgugaagaacggccuguaccccaaccugagcaagagcuacgccaacaacaaggagaaggaggugcuggugcuguggggcgugcaccacccccccaacaucguggaccagaagacccuguaccacaccgagaacgccuacgugagcguggugagcagccacuacagcagaaaguucacccccgagaucgccaagagacccaaggugagaaaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagacccccagaggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 158942 - RNA, 1698 nt, Artificial Sequence
  derived and/or modified sequence opt4 from hemagglutinin__InfluenzaA__ADW10776
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacgacaaggagaaggaggugcuggugcuguggggcgugcaccacccccccaacaucguggaccagaagacccuguacagaaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 158943 - RNA, 1698 nt, Artificial Sequence
  derived and/or modified sequence opt4 from hemagglutinin__InfluenzaA__ADW10787
augaaggugaagauccuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccgugaagaacggccuguaccccaaccugagcaagagcuacgccaacaacaaggagaaggaggugcuggugcuguggggcgugcaccacccccccaacaucguggaccagaagacccuguacagaaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagacccccagaggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 158944 - RNA, 1698 nt, Artificial Sequence
  derived and/or modified sequence opt4 from hemagglutinin__InfluenzaA__ADW10798
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucguggaccagaagacccuguacagaaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccaugggcaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaguggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 158945 - RNA, 1698 nt, Artificial Sequence; identical to SEQ ID NO: 158941
  derived and/or modified sequence opt4 from hemagglutinin__InfluenzaA__ADW10809

SEQ ID NO: 158946 - RNA, 1698 nt, Artificial Sequence; identical to SEQ ID NO: 156136
  derived and/or modified sequence opt4 from hemagglutinin__InfluenzaA__ADW10820

SEQ ID NO: 158947 - RNA, 1698 nt, Artificial Sequence; identical to SEQ ID NO: 155651
  derived and/or modified sequence opt4 from hemagglutinin__InfluenzaA__ADW10831

SEQ ID NO: 158948 - RNA, 1698 nt, Artificial Sequence
  derived and/or modified sequence opt4 from hemagglutinin__InfluenzaA__ADW10842
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccgugaagaacggccuguaccccaaccugagcaagagcuacgccaacaacaaggagaaggaggugcuggugcuguggggcgugcaccacccccccaacaucguggaccagaagacccuguacagaaccgagaacgccuacgugagcguggugagcagccacuacagcagaaaguucgcccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagacccccagaggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 158949 - RNA, 1698 nt, Artificial Sequence; identical to SEQ ID NO: 158492
  derived and/or modified sequence opt4 from hemagglutinin__InfluenzaA__ADW10853

SEQ ID NO: 158950 - RNA, 1698 nt, Artificial Sequence; identical to SEQ ID NO: 158941
  derived and/or modified sequence opt4 from hemagglutinin__InfluenzaA__ADW10864

SEQ ID NO: 158951 - RNA, 1698 nt, Artificial Sequence; identical to SEQ ID NO: 158941
  derived and/or modified sequence opt4 from hemagglutinin__InfluenzaA__ADW10875

SEQ ID NO: 158952 - RNA, 1698 nt, Artificial Sequence; identical to SEQ ID NO: 156136
  derived and/or modified sequence opt4 from hemagglutinin__InfluenzaA__ADW10886

SEQ ID NO: 158953 - RNA, 1698 nt, Artificial Sequence
  derived and/or modified sequence opt4 from hemagglutinin__InfluenzaA__ADW10897
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccagcaucagcgaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacaccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggaggugggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 158954 - RNA, 1701 nt, Artificial Sequence
  derived and/or modified sequence opt4 from hemagglutinin__InfluenzaA__ADW23115
augaagaccaucaucgcccugagcuacauccugugccugguguucgcccagaagcugcccggcaacggcaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccacagcaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 158955 - RNA, 1701 nt, Artificial Sequence
  derived and/or modified sequence opt4 from hemagglutinin__InfluenzaA__ADW54481
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158956 - RNA, 1701 nt, Artificial Sequence
  derived and/or modified sequence opt4 from hemagglutinin__InfluenzaA__ADW54512
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucaagagauucgagaucuuccccaagaccagcagcuggcccaaccacgacagcaacaagggcgugaccaccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccacccccccaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158957 - RNA, 1701 nt, Artificial Sequence
  derived and/or modified sequence opt4 from hemagglutinin__InfluenzaA__ADW54527
augaaggccauccugguggugcugcuguacaccuucgccaccgccagcgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccaccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccacccccccaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaacggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158958 - RNA, 1701 nt, Artificial Sequence; identical to SEQ ID NO: 158955
  derived and/or modified sequence opt4 from hemagglutinin__InfluenzaA__ADW65825

SEQ ID NO: 158959 - RNA, 1701 nt, Artificial Sequence
  derived and/or modified sequence opt4 from hemagglutinin__InfluenzaA__ADW82135
augaagaccaucaucgcccugagcuacauccugugccugguguucgcccagaagcugcccggcaacgacaacagcaccgccacccugugccugggccaccacgccgugcccaacggcaccguggugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguacaccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 158960 - RNA, 1701 nt, Artificial Sequence; identical to SEQ ID NO: 158959
  derived and/or modified sequence opt4 from hemagglutinin__InfluenzaA__ADW82155

SEQ ID NO: 158961 - RNA, 1701 nt, Artificial Sequence; identical to SEQ ID NO: 158959
  derived and/or modified sequence opt4 from hemagglutinin__InfluenzaA__ADW82166

SEQ ID NO: 158962 - RNA, 1701 nt, Artificial Sequence; identical to SEQ ID NO: 158959
  derived and/or modified sequence opt4 from hemagglutinin__InfluenzaA__ADW82177

SEQ ID NO: 158963 - RNA, 1701 nt, Artificial Sequence; identical to SEQ ID NO: 155189
  derived and/or modified sequence opt4 from hemagglutinin__InfluenzaA__ADW82188

SEQ ID NO: 158964 - RNA, 1701 nt, Artificial Sequence; identical to SEQ ID NO: 155189
  derived and/or modified sequence opt4 from hemagglutinin__InfluenzaA__ADW82198

SEQ ID NO: 158965 - RNA, 1701 nt, Artificial Sequence; identical to SEQ ID NO: 155189
  derived and/or modified sequence opt4 from hemagglutinin__InfluenzaA__ADW82208

SEQ ID NO: 158966 - RNA, 1701 nt, Artificial Sequence; identical to SEQ ID NO: 155189
  derived and/or modified sequence opt4 from hemagglutinin__InfluenzaA__ADW82218

SEQ ID NO: 158967 - RNA, 1701 nt, Artificial Sequence; identical to SEQ ID NO: 155189
  derived and/or modified sequence opt4 from hemagglutinin__InfluenzaA__ADW82228

SEQ ID NO: 158968 - RNA, 1701 nt, Artificial Sequence; identical to SEQ ID NO: 155189
  derived and/or modified sequence opt4 from hemagglutinin__InfluenzaA__ADW82238

SEQ ID NO: 158969 - RNA, 1701 nt, Artificial Sequence; identical to SEQ ID NO: 155189
  derived and/or modified sequence opt4 from hemagglutinin__InfluenzaA__ADW82248

SEQ ID NO: 158970 - RNA, 1701 nt, Artificial Sequence; identical to SEQ ID NO: 155189
  derived and/or modified sequence opt4 from hemagglutinin__InfluenzaA__ADW82258

SEQ ID NO: 158971 - RNA, 1701 nt, Artificial Sequence
  derived and/or modified sequence opt4 from hemagglutinin__InfluenzaA__ADW82268
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaauccaccagauccuggccaucuacagcaccguggccagcagccuggugcugguggugagccugggcgccaucagcuucuggaugugcagcaacggcagccugcagugcagaaucugcaucuga

SEQ ID NO: 158972 - RNA, 1701 nt, Artificial Sequence; identical to SEQ ID NO: 158959
  derived and/or modified sequence opt4 from hemagglutinin__InfluenzaA__ADW93760

SEQ ID NO: 158973 - RNA, 1701 nt, Artificial Sequence
  derived and/or modified sequence opt4 from hemagglutinin__InfluenzaA__ADW95319
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158974 - RNA, 1701 nt, Artificial Sequence
  derived and/or modified sequence opt4 from hemagglutinin__InfluenzaA__ADW95332
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158975 - RNA, 1701 nt, Artificial Sequence
  derived and/or modified sequence opt4 from hemagglutinin__InfluenzaA__ADX21078
augaagaccaucaucgcccugagcuacauccugugccugguguucgcccagaagcugcccggcaacgacaacagcaccgccacccugugccugggccaccacgccgugcccaacggcaccguggugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguacaccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucagaaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 158976 - RNA, 1701 nt, Artificial Sequence; identical to SEQ ID NO: 158975
  derived and/or modified sequence opt4 from hemagglutinin__InfluenzaA__ADX21088

SEQ ID NO: 158977 - RNA, 1701 nt, Artificial Sequence
  derived and/or modified sequence opt4 from hemagglutinin__InfluenzaA__ADX21098
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcagcaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaauccaccagauccuggccaucuacagcaccguggccagcagccuggugcugguggugagccugggcgccaucagcuucuggaugugcagcaacggcagccugcagugcagaaucugcaucuga

SEQ ID NO: 158978 - RNA, 1701 nt, Artificial Sequence; identical to SEQ ID NO: 156108
  derived and/or modified sequence opt4 from hemagglutinin__InfluenzaA__ADX36109

SEQ ID NO: 158979 - RNA, 1701 nt, Artificial Sequence
  derived and/or modified sequence opt4 from hemagglutinin__InfluenzaA__ADX96278
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccgugaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggaggugggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccgccgccagcagccuggugcugguggugagccugggcgccaucagcuucuggaugugcagcaacggcagccugcagugcagaaucugcaucuga

SEQ ID NO: 158980 - RNA, 1701 nt, Artificial Sequence
  derived and/or modified sequence opt4 from hemagglutinin__InfluenzaA__ADX96288
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagcagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggaggugggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccgccgccagcagccuggugcugguggugagccugggcgccaucagcuucuggaugugcagcaacggcagccugcagugcagaaucugcaucuga

SEQ ID NO: 158981 - RNA, 1701 nt, Artificial Sequence
  derived and/or modified sequence opt4 from hemagglutinin__InfluenzaA__ADX96298
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgugaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaccggcagccugcagugcagaaucugcaucuga

SEQ ID NO: 158982 - RNA, 1701 nt, Artificial Sequence; identical to SEQ ID NO: 156786
  derived and/or modified sequence opt4 from hemagglutinin__InfluenzaA__ADX96308

SEQ ID NO: 158983 - RNA, 1701 nt, Artificial Sequence
  derived and/or modified sequence opt4 from hemagglutinin__InfluenzaA__ADX96318
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacagcuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158984 - RNA, 1701 nt, Artificial Sequence
  derived and/or modified sequence opt4 from hemagglutinin__InfluenzaA__ADX96328
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggcccccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158985 - RNA, 1701 nt, Artificial Sequence
  derived and/or modified sequence opt4 from hemagglutinin__InfluenzaA__ADX96347
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacaacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158986 - RNA, 1701 nt, Artificial Sequence
  derived and/or modified sequence opt4 from hemagglutinin__InfluenzaA__ADX96357
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgugaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158987 - RNA, 1701 nt, Artificial Sequence; identical to SEQ ID NO: 158126
  derived and/or modified sequence opt4 from hemagglutinin__InfluenzaA__ADX96367

SEQ ID NO: 158988 - RNA, 1701 nt, Artificial Sequence
  derived and/or modified sequence opt4 from hemagglutinin__InfluenzaA__ADX96378
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccauccacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158989 - RNA, 1701 nt, Artificial Sequence; identical to SEQ ID NO: 158988
  derived and/or modified sequence opt4 from hemagglutinin__InfluenzaA__ADX96398

SEQ ID NO: 158990 - RNA, 1701 nt, Artificial Sequence
  derived and/or modified sequence opt4 from hemagglutinin__InfluenzaA__ADX96408
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccauccacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158991 - RNA, 1701 nt, Artificial Sequence; identical to SEQ ID NO: 155502
  derived and/or modified sequence opt4 from hemagglutinin__InfluenzaA__ADX96427

SEQ ID NO: 158992 - RNA, 1701 nt, Artificial Sequence
  derived and/or modified sequence opt4 from hemagglutinin__InfluenzaA__ADX96437
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagacuggagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggaggugggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccgccgccagcagccuggugcugguggugagccugggcgccaucagcuucuggaugugcagcaacggcagccugcagugcagaaucugcaucuga

SEQ ID NO: 158993 - RNA, 1701 nt, Artificial Sequence; identical to SEQ ID NO: 155176
  derived and/or modified sequence opt4 from hemagglutinin__InfluenzaA__ADX96447

SEQ ID NO: 158994 - RNA, 1701 nt, Artificial Sequence; identical to SEQ ID NO: 155189
  derived and/or modified sequence opt4 from hemagglutinin__InfluenzaA__ADX96497

SEQ ID NO: 158995 - RNA, 1701 nt, Artificial Sequence
  derived and/or modified sequence opt4 from hemagglutinin__InfluenzaA__ADX96507
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaccggcagccugcagugcagaaucugcaucuga

SEQ ID NO: 158996 - RNA, 1701 nt, Artificial Sequence; identical to SEQ ID NO: 158995
  derived and/or modified sequence opt4 from hemagglutinin__InfluenzaA__ADX96517

SEQ ID NO: 158997 - RNA, 1701 nt, Artificial Sequence
  derived and/or modified sequence opt4 from hemagglutinin__InfluenzaA__ADX96527
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuuccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 158998 - RNA, 1701 nt, Artificial Sequence; identical to SEQ ID NO: 155189
  derived and/or modified sequence opt4 from hemagglutinin__InfluenzaA__ADX96537

SEQ ID NO: 158999 - RNA, 1701 nt, Artificial Sequence; identical to SEQ ID NO: 155189
  derived and/or modified sequence opt4 from hemagglutinin__InfluenzaA__ADX96547

SEQ ID NO: 159000 - RNA, 1701 nt, Artificial Sequence; identical to SEQ ID NO: 156290
  derived and/or modified sequence opt4 from hemagglutinin__InfluenzaA__ADX96557

SEQ ID NO: 159001 - RNA, 1701 nt, Artificial Sequence; identical to SEQ ID NO: 155189
  derived and/or modified sequence opt4 from hemagglutinin__InfluenzaA__ADX96587

SEQ ID NO: 159002 - RNA, 1701 nt, Artificial Sequence; identical to SEQ ID NO: 155176
  derived and/or modified sequence opt4 from hemagglutinin__InfluenzaA__ADX96597

SEQ ID NO: 159003 - RNA, 1701 nt, Artificial Sequence; identical to SEQ ID NO: 155176
  derived and/or modified sequence opt4 from hemagglutinin__InfluenzaA__ADX96607

SEQ ID NO: 159004 - RNA, 1701 nt, Artificial Sequence
  derived and/or modified sequence opt4 from hemagglutinin__InfluenzaA__ADX96627
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagaagaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaccggcagccugcagugcagaaucugcaucuga

SEQ ID NO: 159005 - RNA, 1701 nt, Artificial Sequence; identical to SEQ ID NO: 155636
  derived and/or modified sequence opt4 from hemagglutinin__InfluenzaA__ADX96637

SEQ ID NO: 159006 - RNA, 1701 nt, Artificial Sequence; identical to SEQ ID NO: 155189
  derived and/or modified sequence opt4 from hemagglutinin__InfluenzaA__ADX96647

SEQ ID NO: 159007 - RNA, 1701 nt, Artificial Sequence; identical to SEQ ID NO: 155176
  derived and/or modified sequence opt4 from hemagglutinin__InfluenzaA__ADX96657

SEQ ID NO: 159008 - RNA, 1701 nt, Artificial Sequence; identical to SEQ ID NO: 155189
  derived and/or modified sequence opt4 from hemagglutinin__InfluenzaA__ADX96667

SEQ ID NO: 159009 - RNA, 1701 nt, Artificial Sequence
  derived and/or modified sequence opt4 from hemagglutinin__InfluenzaA__ADX96677
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggaccgugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccacaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159010 - RNA, 1701 nt, Artificial Sequence
  derived and/or modified sequence opt4 from hemagglutinin__InfluenzaA__ADX96687
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucaagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccguguacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159011 - RNA, 1701 nt, Artificial Sequence; identical to SEQ ID NO: 155189
  derived and/or modified sequence opt4 from hemagglutinin__InfluenzaA__ADX96697

SEQ ID NO: 159012 - RNA, 1701 nt, Artificial Sequence
  derived and/or modified sequence opt4 from hemagglutinin__InfluenzaA__ADX96707
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcgacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaccggcagccugcagugcagaaucugcaucuga

SEQ ID NO: 159013 - RNA, 1701 nt, Artificial Sequence; identical to SEQ ID NO: 156349
  derived and/or modified sequence opt4 from hemagglutinin__InfluenzaA__ADX96727

SEQ ID NO: 159014 - RNA, 1701 nt, Artificial Sequence
  derived and/or modified sequence opt4 from hemagglutinin__InfluenzaA__ADX96737
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugaaggagcaggagggcagaaugaacuacuacuggacccugguggagcccggcgacaagaucaccuucgaggccaccggcaaccugguggugcccagauacgccuucgccauggagagaaaggccggcagcggcaucaucaucagcgacacccccgugcacgacugcaacaccaccugccagacccccaagggcgccaucaacaccagccugcccuuccagaacauccacagcaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcuggugaucagccugggcgccaucagcuucuggaugugcagcaccggcagccugcagugcagaaucugcaucuga

SEQ ID NO: 159015 - RNA, 1701 nt, Artificial Sequence; identical to SEQ ID NO: 155189
  derived and/or modified sequence opt4 from hemagglutinin__InfluenzaA__ADX96747

SEQ ID NO: 159016 - RNA, 1701 nt, Artificial Sequence
  derived and/or modified sequence opt4 from hemagglutinin__InfluenzaA__ADX96757
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcggcaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggugcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaccggcagccugcagugcagaaucugcaucuga

SEQ ID NO: 159017 - RNA, 1701 nt, Artificial Sequence
  derived and/or modified sequence opt4 from hemagglutinin__InfluenzaA__ADX96767
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagagcggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaagcuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaccggcagccugcagugcagaaucugcaucuga

SEQ ID NO: 159018 - RNA, 1701 nt, Artificial Sequence
  derived and/or modified sequence opt4 from hemagglutinin__InfluenzaA__ADX96777
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggugcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccacagcaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159019 - RNA, 1701 nt, Artificial Sequence; identical to SEQ ID NO: 155189
  derived and/or modified sequence opt4 from hemagglutinin__InfluenzaA__ADX96787

SEQ ID NO: 159020 - RNA, 1701 nt, Artificial Sequence; identical to SEQ ID NO: 158416
  derived and/or modified sequence opt4 from hemagglutinin__InfluenzaA__ADX96797

SEQ ID NO: 159021 - RNA, 1701 nt, Artificial Sequence
  derived and/or modified sequence opt4 from hemagglutinin__InfluenzaA__ADX96807
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauucagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggaggugggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159022 - RNA, 1701 nt, Artificial Sequence; identical to SEQ ID NO: 155176
  derived and/or modified sequence opt4 from hemagglutinin__InfluenzaA__ADX96817

SEQ ID NO: 159023 - RNA, 1701 nt, Artificial Sequence
  derived and/or modified sequence opt4 from hemagglutinin__InfluenzaA__ADX96837
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugccccuacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggaggugggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaccggcagccugcagugcagaaucugcaucuga

SEQ ID NO: 159024 - RNA, 1701 nt, Artificial Sequence; identical to SEQ ID NO: 155189
  derived and/or modified sequence opt4 from hemagglutinin__InfluenzaA__ADX96847

SEQ ID NO: 159025 - RNA, 1701 nt, Artificial Sequence; identical to SEQ ID NO: 155189
  derived and/or modified sequence opt4 from hemagglutinin__InfluenzaA__ADX96857

SEQ ID NO: 159026 - RNA, 1701 nt, Artificial Sequence; identical to SEQ ID NO: 155369
  derived and/or modified sequence opt4 from hemagglutinin__InfluenzaA__ADX96867

SEQ ID NO: 159027 - RNA, 1701 nt, Artificial Sequence; identical to SEQ ID NO: 158126
  derived and/or modified sequence opt4 from hemagglutinin__InfluenzaA__ADX96877

SEQ ID NO: 159028 - RNA, 1701 nt, Artificial Sequence
  derived and/or modified sequence opt4 from hemagglutinin__InfluenzaA__ADX96897
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccauccacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159029 - RNA, 1701 nt, Artificial Sequence
  derived and/or modified sequence opt4 from hemagglutinin__InfluenzaA__ADX96907
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacagcggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcagcaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159030 - RNA, 1701 nt, Artificial Sequence
  derived and/or modified sequence opt4 from hemagglutinin__InfluenzaA__ADX96927
augaaggccauccugguggugcugcuguacaccuucgccaccgccaacgccgacacccugugcaucggcuaccacgccaacaacagcaccgacaccguggacacccugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggacagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159031 - RNA, 1701 nt, Artificial Sequence; identical to SEQ ID NO: 156609
  derived and/or modified sequence opt4 from hemagglutinin__InfluenzaA__ADX96937

SEQ ID NO: 159032 - RNA, 1701 nt, Artificial Sequence; identical to SEQ ID NO: 155176
  derived and/or modified sequence opt4 from hemagglutinin__InfluenzaA__ADX96947

SEQ ID NO: 159033 - RNA, 1701 nt, Artificial Sequence; identical to SEQ ID NO: 156353
  derived and/or modified sequence opt4 from hemagglutinin__InfluenzaA__ADX96957

SEQ ID NO: 159034 - RNA, 1701 nt, Artificial Sequence; identical to SEQ ID NO: 155502
  derived and/or modified sequence opt4 from hemagglutinin__InfluenzaA__ADX96967

SEQ ID NO: 159035 - RNA, 1701 nt, Artificial Sequence; identical to SEQ ID NO: 155369
  derived and/or modified sequence opt4 from hemagglutinin__InfluenzaA__ADX96977

SEQ ID NO: 159036 - RNA, 1701 nt, Artificial Sequence
  derived and/or modified sequence opt4 from hemagglutinin__InfluenzaA__ADX96987
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcaucaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159037 - RNA, 1701 nt, Artificial Sequence; identical to SEQ ID NO: 155369
  derived and/or modified sequence opt4 from hemagglutinin__InfluenzaA__ADX96997

SEQ ID NO: 159038 - RNA, 1701 nt, Artificial Sequence
  derived and/or modified sequence opt4 from hemagglutinin__InfluenzaA__ADX97007
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacgcccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159039 - RNA, 1701 nt, Artificial Sequence; identical to SEQ ID NO: 158988
  derived and/or modified sequence opt4 from hemagglutinin__InfluenzaA__ADX97018

SEQ ID NO: 159040 - RNA, 1701 nt, Artificial Sequence
  derived and/or modified sequence opt4 from hemagglutinin__InfluenzaA__ADX97028
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagcagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggaggugggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccgccgccagcagccuggugcugguggugagccugggcgccaucagcuucuggaugugcagcaacggcagccugcagugcagaaucugcaucuga

SEQ ID NO: 159041 - RNA, 1701 nt, Artificial Sequence; identical to SEQ ID NO: 157742
  derived and/or modified sequence opt4 from hemagglutinin__InfluenzaA__ADX98640

SEQ ID NO: 159042 - RNA, 1701 nt, Artificial Sequence; identical to SEQ ID NO: 156741
  derived and/or modified sequence opt4 from hemagglutinin__InfluenzaA__ADX98650

SEQ ID NO: 159043 - RNA, 1701 nt, Artificial Sequence
  derived and/or modified sequence opt4 from hemagglutinin__InfluenzaA__ADX98665
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcggcaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccgccgccagcagccuggugcugguggugagccugggcgccaucagcuucuggaugugcagcaacggcagccugcagugcagaaucugcaucuga

SEQ ID NO: 159044 - RNA, 1701 nt, Artificial Sequence; identical to SEQ ID NO: 156353
  derived and/or modified sequence opt4 from hemagglutinin__InfluenzaA__ADX98675

SEQ ID NO: 159045 - RNA, 1701 nt, Artificial Sequence; identical to SEQ ID NO: 156353
  derived and/or modified sequence opt4 from hemagglutinin__InfluenzaA__ADX98695

SEQ ID NO: 159046 - RNA, 1701 nt, Artificial Sequence; identical to SEQ ID NO: 156741
  derived and/or modified sequence opt4 from hemagglutinin__InfluenzaA__ADX98729

SEQ ID NO: 159047 - RNA, 1701 nt, Artificial Sequence; identical to SEQ ID NO: 158072
  derived and/or modified sequence opt4 from hemagglutinin__InfluenzaA__ADX98739

SEQ ID NO: 159048 - RNA, 1701 nt, Artificial Sequence; identical to SEQ ID NO: 157821
  derived and/or modified sequence opt4 from hemagglutinin__InfluenzaA__ADX98748

SEQ ID NO: 159049 - RNA, 1701 nt, Artificial Sequence; identical to SEQ ID NO: 155189
  derived and/or modified sequence opt4 from hemagglutinin__InfluenzaA__ADX98758

SEQ ID NO: 159050 - RNA, 1701 nt, Artificial Sequence; identical to SEQ ID NO: 155542
  derived and/or modified sequence opt4 from hemagglutinin__InfluenzaA__ADX98767

SEQ ID NO: 159051 - RNA, 1701 nt, Artificial Sequence; identical to SEQ ID NO: 156786
  derived and/or modified sequence opt4 from hemagglutinin__InfluenzaA__ADX98777

SEQ ID NO: 159052 - RNA, 1701 nt, Artificial Sequence
  derived and/or modified sequence opt4 from hemagglutinin__InfluenzaA__ADX98785
augaaggccauccugguggugcugcuguacacccuggccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcaucgccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucggcggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159053 - RNA, 1701 nt, Artificial Sequence; identical to SEQ ID NO: 156290
  derived and/or modified sequence opt4 from hemagglutinin__InfluenzaA__ADX98792

SEQ ID NO: 159054 - RNA, 1701 nt, Artificial Sequence; identical to SEQ ID NO: 156290
  derived and/or modified sequence opt4 from hemagglutinin__InfluenzaA__ADX98806

SEQ ID NO: 159055 - RNA, 1701 nt, Artificial Sequence; identical to SEQ ID NO: 158230
  derived and/or modified sequence opt4 from hemagglutinin__InfluenzaA__ADX98818

SEQ ID NO: 159056 - RNA, 1701 nt, Artificial Sequence; identical to SEQ ID NO: 155189
  derived and/or modified sequence opt4 from hemagglutinin__InfluenzaA__ADX98828

SEQ ID NO: 159057 - RNA, 1701 nt, Artificial Sequence; identical to SEQ ID NO: 158580
  derived and/or modified sequence opt4 from hemagglutinin__InfluenzaA__ADX98843

SEQ ID NO: 159058 - RNA, 1701 nt, Artificial Sequence
  derived and/or modified sequence opt4 from hemagglutinin__InfluenzaA__ADX98853
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaucgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuaccacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159059 - RNA, 1701 nt, Artificial Sequence; identical to SEQ ID NO: 156353
  derived and/or modified sequence opt4 from hemagglutinin__InfluenzaA__ADX98860

SEQ ID NO: 159060 - RNA, 1701 nt, Artificial Sequence; identical to SEQ ID NO: 157741
  derived and/or modified sequence opt4 from hemagglutinin__InfluenzaA__ADX98870

SEQ ID NO: 159061 - RNA, 1701 nt, Artificial Sequence
  derived and/or modified sequence opt4 from hemagglutinin__InfluenzaA__ADX98880
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcaucaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159062 - RNA, 1701 nt, Artificial Sequence
  derived and/or modified sequence opt4 from hemagglutinin__InfluenzaA__ADX98890
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccgagagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159063 - RNA, 1701 nt, Artificial Sequence; identical to SEQ ID NO: 156741
  derived and/or modified sequence opt4 from hemagglutinin__InfluenzaA__ADX98900

SEQ ID NO: 159064 - RNA, 1701 nt, Artificial Sequence
  derived and/or modified sequence opt4 from hemagglutinin__InfluenzaA__ADX98910
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccaucagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159065 - RNA, 1701 nt, Artificial Sequence; identical to SEQ ID NO: 156741
  derived and/or modified sequence opt4 from hemagglutinin__InfluenzaA__ADX98920

SEQ ID NO: 159066 - RNA, 1701 nt, Artificial Sequence; identical to SEQ ID NO: 156353
  derived and/or modified sequence opt4 from hemagglutinin__InfluenzaA__ADX98930

SEQ ID NO: 159067 - RNA, 1701 nt, Artificial Sequence; identical to SEQ ID NO: 155980
  derived and/or modified sequence opt4 from hemagglutinin__InfluenzaA__ADX98940

SEQ ID NO: 159068 - RNA, 1701 nt, Artificial Sequence; identical to SEQ ID NO: 157809
  derived and/or modified sequence opt4 from hemagglutinin__InfluenzaA__ADX98950

SEQ ID NO: 159069 - RNA, 1701 nt, Artificial Sequence; identical to SEQ ID NO: 157790
  derived and/or modified sequence opt4 from hemagglutinin__InfluenzaA__ADX98960

SEQ ID NO: 159070 - RNA, 1701 nt, Artificial Sequence
  derived and/or modified sequence opt4 from hemagglutinin__InfluenzaA__ADX98970
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagggccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159071 - RNA, 1701 nt, Artificial Sequence; identical to SEQ ID NO: 156290
  derived and/or modified sequence opt4 from hemagglutinin__InfluenzaA__ADX98980

SEQ ID NO: 159072 - RNA, 1701 nt, Artificial Sequence; identical to SEQ ID NO: 155189
  derived and/or modified sequence opt4 from hemagglutinin__InfluenzaA__ADX98990

SEQ ID NO: 159073 - RNA, 1701 nt, Artificial Sequence; identical to SEQ ID NO: 156353
  derived and/or modified sequence opt4 from hemagglutinin__InfluenzaA__ADX99000

SEQ ID NO: 159074 - RNA, 1698 nt, Artificial Sequence
  derived and/or modified sequence opt4 from hemagglutinin__InfluenzaA__ADX99581
augaaggccaaccugcuggugcugcugagcgcccuggccgccgccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcaacaucgccggcuggcugcugggcaaccccgagugcgacccccugcugcccgugagaagcuggagcuacaucguggagacccccaacagcgagaacggcaucugcuaccccggcgacuucaucgacuacgaggagcugagagagcagcugagcagcgugagcagcuucgagagauucgagaucuuccccaaggagagcagcuggcccaaccacaacaccaacggcgugaccgccgccugcagccacgagggcaagagcagcuucuacagaaaccugcuguggcugaccgagaaggagggcagcuaccccaagcugaagaacagcuacgugaacaagaagggcaaggaggugcuggugcuguggggcauccaccacccccccaacagcaaggagcagcagaaccuguaccagaacgagaacgccuacgugagcguggugaccagcaacuacaacagaagauucacccccgagaucgccgagagacccaaggugagagaccaggccggcagaaugaacuacuacuggacccugcugaagcccggcgacaccaucaucuucgaggccaacggcaaccugaucgcccccauguacgccuucgcccugagcagaggcuucggcagcggcaucaucaccagcaacgccagcaugcacgagugcaacaccaagugccagaccccccugggcgccaucaacagcagccugcccuaccagaacauccaccccgugaccaucggcgagugccccaaguacgugagaagcgccaagcugagaauggugaccggccugagaaacacccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacaccgugaucgagaagaugaacauccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcgacaacgagugcauggagagcgugagaaacggcaccuacgacuaccccaaguacagcgaggagagcaagcugaacagagagaagguggacggcgugaagcuggagagcaugggcaucuaccagauccuggccaucuacagcaccguggccagcagccuggugcugcuggugagccugggcgccaucagcuucuggaugugcagcaacggcagccugcagugcagaaucugcaucuga

SEQ ID NO: 159075 - RNA, 1698 nt, Artificial Sequence; identical to SEQ ID NO: 159074
  derived and/or modified sequence opt4 from hemagglutinin__InfluenzaA__ADX99592

SEQ ID NO: 159076 - RNA, 1698 nt, Artificial Sequence; identical to SEQ ID NO: 159074
  derived and/or modified sequence opt4 from hemagglutinin__InfluenzaA__ADX99603

SEQ ID NO: 159077 - RNA, 1698 nt, Artificial Sequence
  derived and/or modified sequence opt4 from hemagglutinin__InfluenzaA__ADX99614
augaaggccaaccugcuggugcugcugagcgcccuggccgccgccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcaacaucgccggcuggcugcugggcaaccccgagugcgacccccugcugcccgugagaagcuggagcuacaucguggagacccccaacagcgagaacggcaucugcuaccccggcgacuucaucgacuacgaggagcugagagagcagcugagcagcgugagcagcuucgagagauucgagaucuuccccaaggagagcagcuggcccaaccacaacaccaacggcgugaccgccgccugcagccacgagggcaagagcagcuucuacagaaaccugcuguggcugaccgagaagaagggcagcuaccccaagcugaagaacagcuacgugaacaagaagggcaaggaggugcuggugcuguggggcauccaccacccccccaacagcaaggagcagcagaaccuguaccagaacgagaacgccuacgugagcguggugaccagcaacuacaacagaagauucacccccgagaucgccgagagacccaaggugagagaccaggccggcagaaugaacuacuacuggacccugcugaagcccggcgacaccaucaucuucgaggccaacggcaaccugaucgcccccauguacgccuucgcccugagcagaggcuucggcagcggcaucaucaccagcaacgccagcaugcacgagugcaacaccaagugccagaccccccugggcgccaucaacagcagccugcccuaccagaacauccaccccgugaccaucggcgagugccccaaguacgugagaagcgccaagcugagaauggugaccggccugagaaacacccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacaccgugaucgagaagaugaacauccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcgacaacgagugcauggagagcgugagaaacggcaccuacgacuaccccaaguacagcgaggagagcaagcugaacagagagaagguggacggcgugaagcuggagagcaugggcaucuaccagauccuggccaucuacagcaccguggccagcagccuggugcugcuggugagccugggcgccaucagcuucuggaugugcagcaacggcagccugcagugcagaaucugcaucuga

SEQ ID NO: 159078 - RNA, 1698 nt, Artificial Sequence
  derived and/or modified sequence opt4 from hemagglutinin__InfluenzaA__ADX99625
augaaggccaaccugcuggugcugcugagcgcccuggccgccgccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcaacaucgccggcuggcugcugggcaaccccgagugcgacccccugcugcccgugagaagcuggagcuacaucguggagacccccaacagcgagaacggcaucugcuaccccggcgacuucaucgacuacgaggagcugagagagcagcugagcagcgugagcagcuucgagagauucgagaucuuccccaaggagagcagcuggcccaaccacaacaccaacggcgugaccgccgccugcagccacgagggcaagagcagcuucuacagaaaccugcuguggcugaccgagaaggagggcagcuaccccaagcugaagaacagcuacgugaacaagaagggcaaggaggugcuggugcuguggggcauccaccacccccccaacagcaaggagcagcagaaccuguaccagaacgagaacgccuacgugagcguggugaccagcaacuacaacagaagauucacccccgagaucgccgagagacccaaggugagagaccaggccggcagaaugaacuacuacuggacccugcugaagcccggcgacaccaucaucuucggcgccaacggcaaccugaucgcccccauguacgccuucgcccugagcagaggcuucggcagcggcaucaucaccagcaacgccagcaugcacgagugcaacaccaagugccagaccccccugggcgccaucaacagcagccugcccuaccagaacauccaccccgugaccaucggcgagugccccaaguacgugagaagcgccaagcugagaauggugaccggccugagaaacacccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacaccgugaucgagaagaugaacauccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcgacaacgagugcauggagagcgugagaaacggcaccuacgacuaccccaaguacagcgaggagagcaagcugaacagagagaagguggacggcgugaagcuggagagcaugggcaucuaccagauccuggccaucuacagcaccguggccagcagccuggugcugcuggugagccugggcgccaucagcuucuggaugugcagcaacggcagccugcagugcagaaucugcaucuga

SEQ ID NO: 159079 - RNA, 1698 nt, Artificial Sequence
  derived and/or modified sequence opt4 from hemagglutinin__InfluenzaA__ADX99636
augaaggccaaccugcuggugcugcugagcgcccuggccgccgccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcaacaucgccggcuggcugcugggcaaccccgagugcgacccccugcugcccgugagaagcuggagcuacaucguggagacccccaacagcgagaacggcaucugcuaccccggcgacuucaucgacuacgaggagcugagagagcagcugagcagcgugagcagcuucgagagauucgagaucuuccccaaggagagcagcuggcccaaccacaacaccaacggcgugaccgccgccugcagccacgagggcaagagcagcuucuacagaaaccugcuguggcugaccaagaaggagggcagcuaccccaagcugaagaacagcuacgugaacaagaagggcaaggaggugcuggugcuguggggcauccaccacccccccaacagcaaggagcagcagaaccuguaccagaacgagaacgccuacgugagcguggugaccagcaacuacaacagaagauucacccccgagaucgccgagagacccaaggugagagaccaggccggcagaaugaacuacuacuggacccugcugaagcccggcgacaccaucaucuucgaggccaacggcaaccugaucgcccccauguacgccuucgcccugagcagaggcuucggcagcggcaucaucaccagcaacgccagcaugcacgagugcaacaccaagugccagaccccccugggcgccaucaacagcagccugcccuaccagaacauccaccccgugaccaucggcgagugccccaaguacgugagaagcgccaagcugagaauggugaccggccugagaaacacccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacaccgugaucgagaagaugaacauccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcgacaacgagugcauggagagcgugagaaacggcaccuacgacuaccccaaguacagcgaggagagcaagcugaacagagagaagguggacggcgugaagcuggagagcaugggcaucuaccagauccuggccaucuacagcaccguggccagcagccuggugcugcuggugagccugggcgccaucagcuucuggaugugcagcaacggcagccugcagugcagaaucugcaucuga

SEQ ID NO: 159080 - RNA, 1698 nt, Artificial Sequence; identical to SEQ ID NO: 155798
  derived and/or modified sequence opt4 from hemagglutinin__InfluenzaA__ADX99647

SEQ ID NO: 159081 - RNA, 1698 nt, Artificial Sequence
  derived and/or modified sequence opt4 from hemagglutinin__InfluenzaA__ADX99680
augaaggccaaccugcuggugcugcugugcgcccuggccgccgccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcaacaucgccggcuggcugcugggcaaccccgagugcgacccccugcugcccgugagaagcuggagcuacaucguggagacccccaacagcgagaacggcaucugcuaccccggcgacuucaucgacuacgaggagcugagagagcagcugagcagcgugagcagcuucgagagauucgagaucuuccccaaggagagcagcuggagcaaccacaacaccaacggcgugaccgccgccugcagccacgagggcaagagcagcuucuacagaaaccugcuguggcugaccgagaaggagggcagcuaccccaagcugaagaacagcuacgugaacaagaagggcaaggaggugcuggugcuguggggcauccaccacccccccaacagcaaggagcagcagaaccuguaccagaacgagaacgccuacgugagcguggugaccagcaacuacaacagaagauucacccccgagaucgccgagagacccaaggugagagaccaggccggcagaaugaacuacuacuggacccugcugaagcccggcgacaccaucaucuucgaggccaacggcaaccugaucgcccccauguacgccuucgcccugagcagaggcuucggcagcggcaucaucaccagcaacgccagcaugcacgagugcaacaccaagugccagaccccccugggcgccaucaacagcagccugcccuaccagaacauccaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacaccgugaucgagaagaugaacauccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcgacaacgagugcauggagagcgugagaaacggcaccuacgacuaccccaaguacagcgaggagagcaagcugaacagagagaagguggacggcgugaagcuggagagcaugggcaucuaccagauccuggccaucuacagcaccguggccagcagccuggugcugcuggugagccugggcgccaucagcuucuggaugugcagcaacggcagccugcagugcagaaucugcaucuga

SEQ ID NO: 159082 - RNA, 1698 nt, Artificial Sequence
  derived and/or modified sequence opt4 from hemagglutinin__InfluenzaA__ADX99702
augaaggccaaccugcuggugcugcugugcgcccuggccgccgccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcaacaucgccggcuggcugcugggcaaccccgagugcgacccccugcugcccgugagaagcuggagcuacaucguggagacccccaacagcgagaacggcaucugcuaccccggcgacuucaucgacuacgaggagcugagagagcagcugagcagcgugagcagcuucgagagauucgagaucuuccccaaggagagcagcuggcccaaccacaacaccaacggcgugaccgccgccugcagccacgagggcaagagcagcuucuacagaaaccugcuguggcugaccgagaaggagggcagcuaccccaagcugaagaagagcuacgugaacaagaagggcaaggaggugcuggugcuguggggcauccaccacccccccaacagcaaggagcagcagaaccuguaccagaacgagaacgccuacgugagcguggugaccagcaacuacaacagaagauucacccccgagaucgccgagagacccaaggugagagaccaggccggcagaaugaacuacuacuggacccugcugaagcccggcgacaccaucaucuucgaggccaacggcaaccugaucgcccccauguacgccuucgcccugagcagaggcuucggcagcggcaucaucaccagcaacgccagcaugcacgagugcaacaccaagugccagaccccccugggcgccaucaacagcagccugcccuaccagaacauccaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacaccgugaucgagaagaugaacauccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcgacaacgagugcauggagagcgugagaaacggcaccuacgacuaccccaaguacagcgaggagagcaagcugaacagagagaagguggacggcgugaagcuggagagcaugggcaucuaccagauccuggccaucuacagcaccguggccagcagccuggugcugcuggugagccugggcgccaucagcuucuggaugugcagcaacggcagccugcagugcagaaucugcaucuga

SEQ ID NO: 159083 - RNA, 1698 nt, Artificial Sequence; identical to SEQ ID NO: 159082
  derived and/or modified sequence opt4 from hemagglutinin__InfluenzaA__ADX99843

SEQ ID NO: 159084 - RNA, 1698 nt, Artificial Sequence
  derived and/or modified sequence opt4 from hemagglutinin__InfluenzaA__ADX99854
augaaggccaaccugcuggugcugcugugcgcccuggccgccgccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcaacaucgccggcuggcugcugggcaaccccgagugcgacccccugcugcccgugagaagcuggagcuacaucguggagacccccaacagcgagaacggcaucugcuaccccggcgacuucaucgacuacgaggagcugagagagcagcugagcagcgugagcagcuucgagagauucgagaucuuccccaaggagagcagcuggcccaaccacaacaccaacggcgugaccgccgccugcagccacgagggcaagagcagcuucuacagaaaccugcuguggcugaccgagaaggagggcagcuaccugaagcugaagaacagcuacgugaacaagaagggcaaggaggugcuggugcuguggggcauccaccacccccccaacagcaaggagcagcagaaccuguaccagaacgagaacgccuacgugagcguggugaccagcaacuacaacagaagauucacccccgagaucgccgagagacccaaggugagagaccaggccggcagaaugaacuacuacuggacccugcugaagcccggcgacaccaucaucuucgaggccaacggcaaccugaucgcccccauguacgccuucgcccugagcagaggcuucggcagcggcaucaucaccagcaacgccagcaugcacgagugcaacaccaagugccagaccccccugggcgccaucaacagcagccugcccuaccagaacauccaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacaccgugaucgagaagaugaacauccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcgacaacgagugcauggagagcgugagaaacggcaccuacgacuaccccaaguacagcgaggagagcaagcugaacagagagaagguggacggcgugaagcuggagagcaugggcaucuaccagauccuggccaucuacagcaccguggccagcagccuggugcugcuggugagccugggcgccaucagcuucuggaugugcagcaacggcagccugcagugcagaaucugcaucuga

SEQ ID NO: 159085 - RNA, 1698 nt, Artificial Sequence
  derived and/or modified sequence opt4 from hemagglutinin__InfluenzaA__ADX99865
augaaggccaaccugcuggugcugcugugcgcccuggccgccgccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcaacaucgccggcuggcugcugggcaaccccgagugcgacccccugcugcccgugagaagcuggagcuacaucguggagacccccaacagcgagaacggcaucugcuaccccggcgacuucaucgacuacgaggagcugagagagcagcugagcagcgugagcagcuucgagagauucgagaucuuccccaaggagagcagcuggcccaaccacaacaccaacggcgugaccgccgccugcagccacgagggcaagagcagcuucuacagaaaccugcuguggcugaccgagaaggagggcagcuaccccaagcagaagaacagcuacgugaacaagaagggcaaggaggugcuggugcuguggggcauccaccacccccccaacagcaaggagcagcagaaccuguaccagaacgagaacgccuacgugagcguggugaccagcaacuacaacagaagauucacccccgagaucgccgagagacccaaggugagagaccaggccggcagaaugaacuacuacuggacccugcugaagcccggcgacaccaucaucuucgaggccaacggcaaccugaucgcccccauguacgccuucgcccugagcagaggcuucggcagcggcaucaucaccagcaacgccagcaugcacgagugcaacaccaagugccagaccccccugggcgccaucaacagcagccugcccuaccagaacauccaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacaccgugaucgagaagaugaacauccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcgacaacgagugcauggagagcgugagaaacggcaccuacgacuaccccaaguacagcgaggagagcaagcugaacagagagaagguggacggcgugaagcuggagagcaugggcaucuaccagauccuggccaucuacagcaccguggccagcagccuggugcugcuggugagccugggcgccaucagcuucuggaugugcagcaacggcagccugcagugcagaaucugcaucuga

SEQ ID NO: 159086 - RNA, 1698 nt, Artificial Sequence
  derived and/or modified sequence opt4 from hemagglutinin__InfluenzaA__ADX99887
augaaggccaaccugcuggugcugcugugcgcccuggccgccgccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcaacaucgccggcuggcugcugggcaaccccgagugcgacccccugcugcccgugagaagcuggagcuacaucguggagacccccaacagcgagaacggcaucugcuaccccggcgacuucaucgacuacgaggagcugagagagcagcugagcagcgugagcagcuucgagagauucgagaucuuccccaaggagagcagcuggcccaaccacaacaccaacggcgugaccgccgccugcagccacgagggcaagagcagcuucuacagaaaccugcuguggcugaccgagaaggagggcagcuaccccaagcuggagaacagcuacgugaacaagaagggcaaggaggugcuggugcuguggggcauccaccacccccccaacagcaaggagcagcagaaccuguaccagaacgagaacgccuacgugagcguggugaccagcaacuacaacagaagauucacccccgagaucgccgagagaagcaaggugagagaccaggccggcagaaugaacuacuacuggacccugcugaagcccggcgacaccaucaucuucgaggccaacggcaaccugaucgcccccauguacgccuucgcccugagcagaggcuucggcagcggcaucaucaccagcaacgccagcaugcacgagugcaacaccaagugccagaccccccugggcgccaucaacagcagccugcccuaccagaacauccaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacaccgugaucgagaagaugaacauccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcgacaacgagugcauggagagcgugagaaacggcaccuacgacuaccccaaguacagcgaggagagcaagcugaacagagagaagguggacggcgugaagcuggagagcaugggcaucuaccagauccuggccaucuacagcaccguggccagcagccuggugcugcuggugagccugggcgccaucagcuucuggaugugcagcaacggcagccugcagugcagaaucugcaucuga

SEQ ID NO: 159087 - RNA, 1698 nt, Artificial Sequence
  derived and/or modified sequence opt4 from hemagglutinin__InfluenzaA__ADX99898
augaaggccaaccugcuggugcugcugugcgcccuggccgccgccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcaacaucgccggcuggcugcugggcaaccccgagugcgacccccugcugcccgugagaagcuggagcuacaucguggagacccccaacagcgagaacggcaucugcuaccccggcgacuucaucgacuacgaggagcugagagagcagcugagcagcgugagcagcuucgagagauucgagaucuuccccaaggagagcagcuggcccaaccacaacaccaacggcgugaccgccgccugcagccacgagggcaagagcagcuucuacagaaaccugcuguggcugaccgagaaggagggcagcuaccccaagcugaagaacuacuacgugaacaagaagggcaaggaggugcuggugcuguggggcauccaccacccccccaacagcaaggagcagcagaaccuguaccagaacgagaacgccuacgugagcguggugaccagcaacuacaacagaagauucacccccgagaucgccgagagacccaaggugagagaccaggccggcagaaugaacuacuacuggacccugcugaagcccggcgacaccaucaucuucgaggccaacggcaaccugaucgcccccauguacgccuucgcccugagcagaggcuucggcagcggcaucaucaccagcaacgccagcaugcacgagugcaacaccaagugccagaccccccugggcgccaucaacagcagccugcccuaccagaacauccaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacaccgugaucgagaagaugaacauccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcgacaacgagugcauggagagcgugagaaacggcaccuacgacuaccccaaguacagcgaggagagcaagcugaacagagagaagguggacggcgugaagcuggagagcaugggcaucuaccagauccuggccaucuacagcaccguggccagcagccuggugcugcuggugagccugggcgccaucagcuucuggaugugcagcaacggcagccugcagugcagaaucugcaucuga

SEQ ID NO: 159088 - RNA, 1698 nt, Artificial Sequence
  derived and/or modified sequence opt4 from hemagglutinin__InfluenzaA__ADX99909
augaaggccaaccugcuggugcugcugugcgcccuggccgccgccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcaacaucgccggcuggcugcugggcaaccccgagugcgacccccugcugcccgugagaagcuggagcuacaucguggagacccccaacagcgagaacggcaucugcuaccccggcgacuucaucgacuacgaggagcugagagagcagcugagcagcgugagcagcuucgagagauucgagaucuuccccaaggagagcagcuggcccaaccacaacaccaacggcgugaccgccgccugcagccacgagggcaagagcagcuucuacagaaaccugcuguggcugaccgagaaggagggcagcuaccccaagcugaagaacuucuacgugaacaagaagggcaaggaggugcuggugcuguggggcauccaccacccccccaacagcaaggagcagcagaaccuguaccagaacgagaacgccuacgugagcguggugaccagcaacuacaacagaagauucacccccgagaucgccgagagacccaaggugagagaccaggccggcagaaugaacuacuacuggacccugcugaagcccggcgacaccaucaucuucgaggccaacggcaaccugaucgcccccauguacgccuucgcccugagcagaggcuucggcagcggcaucaucaccagcaacgccagcaugcacgagugcaacaccaagugccagaccccccugggcgccaucaacagcagccugcccuaccagaacauccaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacaccgugaucgagaagaugaacauccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcgacaacgagugcauggagagcgugagaaacggcaccuacgacuaccccaaguacagcgaggagagcaagcugaacagagagaagguggacggcgugaagcuggagagcaugggcaucuaccagauccuggccaucuacagcaccguggccagcagccuggugcugcuggugagccugggcgccaucagcuucuggaugugcagcaacggcagccugcagugcagaaucugcaucuga

SEQ ID NO: 159089 - RNA, 1698 nt, Artificial Sequence; identical to SEQ ID NO: 159088
  derived and/or modified sequence opt4 from hemagglutinin__InfluenzaA__ADX99920

SEQ ID NO: 159090 - RNA, 1698 nt, Artificial Sequence
  derived and/or modified sequence opt4 from hemagglutinin__InfluenzaA__ADX99931
augaaggccaaccugcuggugcugcugugcgcccuggccgccgccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcaacaucgccggcuggcugcugggcaaccccgagugcgacccccugcugcccgugagaagcuggagcuacaucguggagacccccaacagcgagaacggcaucugcuaccccggcgacuucaucgacuacgaggagcugagagagcagcugagcagcgugagcagcuucgagagauucgagaucuuccccaaggagagcagcuggcccaaccacaacaccaacggcgugaccgccgccugcagccacgagggcaagagcagcuucuacagaaaccugcuguggcugaccgagaaggagggcagcuaccccaagcuggagaacagcuacgugaacaagaagggcaaggaggugcuggugcuguggggcauccaccacccccccaacagcaaggagcagcagaaccuguaccagaacgagaacgccuacgugagcguggugaccagcaacuacaacagaagauucacccccgagaucgccggcagacccaaggugagagaccaggccggcagaaugaacuacuacuggacccugcugaagcccggcgacaccaucaucuucgaggccaacggcaaccugaucgcccccauguacgccuucgcccugagcagaggcuucggcagcggcaucaucaccagcaacgccagcaugcacgagugcaacaccaagugccagaccccccugggcgccaucaacagcagccugcccuaccagaacauccaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacaccgugaucgagaagaugaacauccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacagaugcuucgaguucuaccacaagugcgacaacgagugcauggagagcgugagaaacggcaccuacgacuaccccaaguacagcgaggagagcaagcugaacagagagaagguggacggcgugaagcuggagagcaugggcaucuaccagauccuggccaucuacagcaccguggccagcagccuggugcugcuggugagccugggcgccaucagcuucuggaugugcagcaacggcagccugcagugcagaaucugcaucuga

SEQ ID NO: 159091 - RNA, 1698 nt, Artificial Sequence
  derived and/or modified sequence opt4 from hemagglutinin__InfluenzaA__ADX99964
augaaggccaaccugcuggugcugcugugcgcccuggccgccgccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcaacaucgccggcuggcugcugggcaaccccgagugcgacccccugcugcccgugagaagcuggagcuacaucguggagacccccaacagcgagaacggcaucugcuaccccggcgacuucaucgacuacgaggagcugagagagcagcugagcagcgugagcagcuucgagagauucgagaucuuccccaaggagagcagcuggcccaagcacaacaccaacggcgugaccgccgccugcagccacgagggcaagagcagcuucuacagaaaccugcuguggcugaccgagaaggagggcagcuaccccaagcugaagaacagcuacgugaacaagaagggcaaggaggugcuggugcuguggggcauccaccacccccccaacagcaaggagcagcagaaccuguaccagaacgagaacgccuacgugagcguggugaccagcaacuacaacagaagauucacccccgagaucgccgagagacccaaggugagagaccaggccggcagaaugaacuacuacuggacccugcugaagcccggcgacaccaucaucuucgaggccaacggcaaccugaucgcccccauguacgccuucgcccugagcagaggcuucggcagcggcaucaucaccagcaacgccagcaugcacgagugcaacaccaagugccagaccccccugggcgccaucaacagcagccugcccuaccagaacauccaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacaccgugaucgagaagaugaacauccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcgacaacgagugcauggagagcgugagaaacggcaccuacgacuaccccaaguacagcgaggagagcaagcugaacagagagaagguggacggcgugaagcuggagagcaugggcaucuaccagauccuggccaucuacagcaccguggccagcagccuggugcugcuggugagccugggcgccaucagcuucuggaugugcagcaacggcagccugcagugcagaaucugcaucuga

SEQ ID NO: 159092 - RNA, 1698 nt, Artificial Sequence
  derived and/or modified sequence opt4 from hemagglutinin__InfluenzaA__ADX99975
augaaggccaaccugcuggugcugcugugcgcccuggccgccgccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcaacaucgccggcuggcugcugggcaaccccgagugcgacccccugcugcccgugagaagcuggagcuacaucguggagacccccaacagcgagaacggcaucugcuaccccggcgacuucaucgacuacgaggagcugagagagcagcugagcagcgugagcagcuucgagagauucgagaucuuccccaaggagagcagcuggcccaaccacaacaccaacggcgugaccgccaccugcagccacgagggcaagagcagcuucuacagaaaccugcuguggcugaccgagaaggagggcagcuaccccgagcugaagaacagcuacgugaacaagaagggcaaggaggugcuggugcuguggggcauccaccacccccccaacagcaaggagcagcagaaccuguaccagaacgagaacgccuacgugagcguggugaccagcaacuacaacagaagauucacccccgagaucgccgagagacccaaggugagagaccaggccggcagaaugaacuacuacuggacccugcugaagcccggcgacaccaucaucuucgaggccaacggcaaccugaucgcccccauguacgccuucgcccugagcagaggcuucggcagcggcaucaucaccagcaacgccagcaugcacgagugcaacaccaagugccagaccccccugggcgccaucaacagcagccugcccuaccagaacauccaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacaccgugaucgagaagaugaacauccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcgacaacgagugcauggagagcgugagaaacggcaccuacgacuaccccaaguacagcgaggagagcaagcugaacagagagaagguggacggcgugaagcuggagagcaugggcaucuaccagauccuggccaucuacagcaccguggccagcagccuggugcugcuggugagccugggcgccaucagcuucuggaugugcagcaacggcagccugcagugcagaaucugcaucuga

SEQ ID NO: 159093 - RNA, 1698 nt, Artificial Sequence
  derived and/or modified sequence opt4 from hemagglutinin__InfluenzaA__ADX99986
augaaggccaaccugcuggugcugcugugcgcccuggccgccgccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcaacaucgccggcuggcugcugggcaaccccaagugcgacccccugcugcccgugagaagcuggagcuacaucguggagacccccaacagcgagaacggcaucugcuaccccggcgacuucaucgacuacgaggagcugagagagcagcugagcagcgugagcagcuucgagagauucgagaucuuccccaaggagagcagcuggcccaaccacaacaccaacggcgugaccgccgccugcagccacgagggcaagagcagcuucuacagaaaccugcuguggcugaccgagaaggagggcagcuaccccaagcuggagaacagcuacgugaacaagaagggcaaggaggugcuggugcuguggggcauccaccacccccccaacagcaaggagcagcagaaccuguaccagaacgagaacgccuacgugagcguggugaccagcaacuacaacagaagauucacccccgagaucgccgagagacccaaggugagagaccaggccggcagaaugaacuacuacuggacccugcugaagcccggcgacaccaucaucuucgaggccaacggcaaccugaucgcccccauguacgccuucgcccugagcagaggcuucggcagcggcaucaucaccagcaacgccagcaugcacgagugcaacaccaagugccagaccccccugggcgccaucaacagcagccugcccuaccagaacauccaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacaccgugaucgagaagaugaacauccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcgacaacgagugcauggagagcgugagaaacggcaccuacgacuaccccaaguacagcgaggagagcaagcugaacagagagaagguggacggcgugaagcuggagagcaugggcaucuaccagauccuggccaucuacagcaccguggccagcagccuggugcugcuggugagccugggcgccaucagcuucuggaugugcagcaacggcagccugcagugcagaaucugcaucuga

SEQ ID NO: 159094 - RNA, 1698 nt, Artificial Sequence
  derived and/or modified sequence opt4 from hemagglutinin__InfluenzaA__ADX99997
augaaggccaaccugcuggugcugcugugcgcccuggccgccgccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcaacaucgccggcuggcugcugggcaaccccgagugcgacccccugcugcccgugagaagcuggagcuacaucguggagacccccaacagcgagaacggcaucugcuaccccggcgacuucaucgacuacgaggagcugagagagcagcugagcagcgugagcagcuucgagagauucgagaucuuccccaaggagagcagcuggcccaaccacaacaccaacggcgugaccgccgccugcagccacgagggcaagagcagcuucuacagaaaccugcuguggcugaccgagaaggagggcagcuaccccaagcuggagaacagcuacgugaacaagaagggcaaggaggugcuggugcuguggggcauccaccacccccccaacagcaaggagcagcagaaccuguaccagaacgagaacgccuacgugagcguggugaccagcaacuacaacagaagauucacccccgagaucgccgagagacccaaggugagagaccaggccggcagaaugaaguacuacuggacccugcugaagcccggcgacaccaucaucuucgaggccaacggcaaccugaucgcccccauguacgccuucgcccugagcagaggcuucggcagcggcaucaucaccagcaacgccagcaugcacgagugcaacaccaagugccagaccccccugggcgccaucaacagcagccugcccuaccagaacauccaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacaccgugaucgagaagaugaacauccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcgacaacgagugcauggagagcgugagaaacggcaccuacgacuaccccaaguacagcgaggagagcaagcugaacagagagaagguggacggcgugaagcuggagagcaugggcaucuaccagauccuggccaucuacagcaccguggccagcagccuggugcugcuggugagccugggcgccaucagcuucuggaugugcagcaacggcagccugcagugcagaaucugcaucuga

SEQ ID NO: 159095 - RNA, 1698 nt, Artificial Sequence
  derived and/or modified sequence opt4 from hemagglutinin__InfluenzaA__ADY00009
augaaggccaaccugcuggugcugcugugcgcccuggccgccgccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcaacaucgccggcuggcugcugggcaaccccgagugcgacccccugcugcccgugagaagcuggagcuacaucguggagacccccaacagcgagaacggcaucugcuaccccggcgacuucaucgacuacgaggagcugagagagcagcugagcagcgugagcagcuucgagagauucgagaucuuccccaaggagagcagcuggcccaaccacaacaccaacggcgugaccgccgccugcagccacgagggcaagagcagcuucuacagaaaccugcuguggcugaccgagaagaagggcagcuaccccaagcuggagaacagcuacgugaacaagaagggcaaggaggugcuggugcuguggggcauccaccacccccccaacagcaaggagcagcagaaccuguaccagaacgagaacgccuacgugagcguggugaccagcaacuacaacagaagauucacccccgagaucgccgagagacccaaggugagagaccaggccggcagaaugaacuacuacuggacccugcugaagcccggcgacaccaucaucuucgaggccaacggcaaccugaucgcccccauguacgccuucgcccugagcagaggcuucggcagcggcaucaucaccagcaacgccagcaugcacgagugcaacaccaagugccagaccccccugggcgccaucaacagcagccugcccuaccagaacauccaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacaccgugaucgagaagaugaacauccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcgacaacgagugcauggagagcgugagaaacggcaccuacgacuaccccaaguacagcgaggagagcaagcugaacagagagaagguggacggcgugaagcuggagagcaugggcaucuaccagauccuggccaucuacagcaccguggccagcagccuggugcugcuggugagccugggcgccaucagcuucuggaugugcagcaacggcagccugcagugcagaaucugcaucuga

SEQ ID NO: 159096 - RNA, 1698 nt, Artificial Sequence; identical to SEQ ID NO: 155798
  derived and/or modified sequence opt4 from hemagglutinin__InfluenzaA__ADY00020

SEQ ID NO: 159097 - RNA, 1698 nt, Artificial Sequence
  derived and/or modified sequence opt4 from hemagglutinin__InfluenzaA__ADY04727
augaaggccaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaagggcagcagcuggcccaaccacaccgugaccggcgugagcgccagcugcagccacaacggcaagagcagcuucuacagaaaccugcuguggcugaccggcaagaacggccuguaccccaaccugagcaugagcuacgugaacaacaaggagaaggaggugcuggugcuguggggcgugcaccacccccccaacaucggcaaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccaugggcgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaaccugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 159098 - RNA, 1701 nt, Artificial Sequence; identical to SEQ ID NO: 156133
  derived and/or modified sequence opt4 from hemagglutinin__InfluenzaA__ADY11836

SEQ ID NO: 159099 - RNA, 1701 nt, Artificial Sequence; identical to SEQ ID NO: 156108
  derived and/or modified sequence opt4 from hemagglutinin__InfluenzaA__ADY17654

SEQ ID NO: 159100 - RNA, 1701 nt, Artificial Sequence
  derived and/or modified sequence opt4 from hemagglutinin__InfluenzaA__ADY17665
augaagaccaucaucgcccugagcuacauccugugccugaucuucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccaggacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgccauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 159101 - RNA, 1701 nt, Artificial Sequence; identical to SEQ ID NO: 156133
  derived and/or modified sequence opt4 from hemagglutinin__InfluenzaA__ADY17676

SEQ ID NO: 159102 - RNA, 1701 nt, Artificial Sequence
  derived and/or modified sequence opt4 from hemagglutinin__InfluenzaA__ADY17687
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccaggacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgccauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcgccgcccugcugggcuucaucaugugggccugccagaagggcaacaucagaugcaacaucugcaucuga

SEQ ID NO: 159103 - RNA, 1701 nt, Artificial Sequence; identical to SEQ ID NO: 156108
  derived and/or modified sequence opt4 from hemagglutinin__InfluenzaA__ADY17698

SEQ ID NO: 159104 - RNA, 1701 nt, Artificial Sequence
  derived and/or modified sequence opt4 from hemagglutinin__InfluenzaA__ADY38719
augaagaccaucaucgcccugagcuacauccugugccugguguucacccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgccauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 159105 - RNA, 1701 nt, Artificial Sequence; identical to SEQ ID NO: 155189
  derived and/or modified sequence opt4 from hemagglutinin__InfluenzaA__ADY38750

SEQ ID NO: 159106 - RNA, 1701 nt, Artificial Sequence; identical to SEQ ID NO: 156353
  derived and/or modified sequence opt4 from hemagglutinin__InfluenzaA__ADY38760

SEQ ID NO: 159107 - RNA, 1701 nt, Artificial Sequence
  derived and/or modified sequence opt4 from hemagglutinin__InfluenzaA__ADZ04607
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaguguaccagauccuggccaucuacagcaccguggccagcagccuggugcugguggugagccugggcgccaucagcuucuggaugugcagcaacggcagccugcagugcagaaucugcaucuga

SEQ ID NO: 159108 - RNA, 1698 nt, Artificial Sequence; identical to SEQ ID NO: 158483
  derived and/or modified sequence opt4 from hemagglutinin__InfluenzaA__ADZ05834

SEQ ID NO: 159109 - RNA, 1698 nt, Artificial Sequence
  derived and/or modified sequence opt4 from hemagglutinin__InfluenzaA__ADZ05845
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagaacagcuucuacagaaaccugcuguggcugaccggcaagaacggccuguaccccaaccugagcaagagcuacgccaacaacaaggagaaggaggugcuggugcuguggggcgugcaccacccccccaacauggccgaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 159110 - RNA, 1701 nt, Artificial Sequence; identical to SEQ ID NO: 154954
  derived and/or modified sequence opt4 from hemagglutinin__InfluenzaA__ADZ05855

SEQ ID NO: 159111 - RNA, 1701 nt, Artificial Sequence
  derived and/or modified sequence opt4 from hemagglutinin__InfluenzaA__ADZ47838
augaaggccauccugguggugcugcuguacacccuggccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccacagcaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagcuucgugcugaucgugagccugggcgccaucagcuucuggaugugcagcaacggcagccugcagugcagaaucugcaucuga

SEQ ID NO: 159112 - RNA, 1701 nt, Artificial Sequence; identical to SEQ ID NO: 156361
  derived and/or modified sequence opt4 from hemagglutinin__InfluenzaA__ADZ47858

SEQ ID NO: 159113 - RNA, 1698 nt, Artificial Sequence
  derived and/or modified sequence opt4 from hemagglutinin__InfluenzaA__ADZ53100
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagaccuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccagcaucaacgaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccagagacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 159114 - RNA, 1701 nt, Artificial Sequence; identical to SEQ ID NO: 155636
  derived and/or modified sequence opt4 from hemagglutinin__InfluenzaA__ADZ53123

SEQ ID NO: 159115 - RNA, 1701 nt, Artificial Sequence; identical to SEQ ID NO: 155431
  derived and/or modified sequence opt4 from hemagglutinin__InfluenzaA__ADZ53125

SEQ ID NO: 159116 - RNA, 1701 nt, Artificial Sequence; identical to SEQ ID NO: 155813
  derived and/or modified sequence opt4 from hemagglutinin__InfluenzaA__ADZ53127

SEQ ID NO: 159117 - RNA, 1701 nt, Artificial Sequence; identical to SEQ ID NO: 155176
  derived and/or modified sequence opt4 from hemagglutinin__InfluenzaA__ADZ53131

SEQ ID NO: 159118 - RNA, 1701 nt, Artificial Sequence; identical to SEQ ID NO: 155189
  derived and/or modified sequence opt4 from hemagglutinin__InfluenzaA__ADZ53133

SEQ ID NO: 159119 - RNA, 1701 nt, Artificial Sequence; identical to SEQ ID NO: 155431
  derived and/or modified sequence opt4 from hemagglutinin__InfluenzaA__ADZ53135

SEQ ID NO: 159120 - RNA, 1701 nt, Artificial Sequence; identical to SEQ ID NO: 156353
  derived and/or modified sequence opt4 from hemagglutinin__InfluenzaA__ADZ53138

SEQ ID NO: 159121 - RNA, 1701 nt, Artificial Sequence; identical to SEQ ID NO: 155189
  derived and/or modified sequence opt4 from hemagglutinin__InfluenzaA__ADZ53140

SEQ ID NO: 159122 - RNA, 1701 nt, Artificial Sequence; identical to SEQ ID NO: 155636
  derived and/or modified sequence opt4 from hemagglutinin__InfluenzaA__ADZ93496

SEQ ID NO: 159123 - RNA, 1689 nt, Artificial Sequence; identical to SEQ ID NO: 154870
  derived and/or modified sequence opt4 from hemagglutinin__InfluenzaA__AEA04365

SEQ ID NO: 159124 - RNA, 1689 nt, Artificial Sequence
  derived and/or modified sequence opt4 from hemagglutinin__InfluenzaA__AEA04376
auggccaucaucuaccugauccugcuguucaccgccgugagaggcgaccagaucugcaucggcuaccacgccaacaacagcaccgagaagguggacaccauccuggagagaaacgugaccgugacccacgccaaggacauccuggagaagacccacaacggcaagcugugcaagcugaacggcauccccccccuggagcugggcgacugcagcaucgccggcuggcugcugggcaaccccgagugcgacagacugcugagcgugcccgaguggagcuacaucauggagaaggagaaccccagagacggccugugcuaccccggcagcuucaacgacuacgaggagcugaagcaccugcugagcagcgugaagcacuucgagaaggugaagauccugcccaaggacagauggacccagcacaccaccaccggcggcagcagagccugcgccgugagcggcaaccccagcuucuucagaaacaugguguggcugaccgagaagggcagcaacuaccccguggccaagggcagcuacaacaacaccagcggcgagcagaugcugaucaucuggggcgugcaccaccccaacgacgagaccgagcagagaacccuguaccagaacgugggcaccuacgugagcgugggcaccagcacccugaacaagagaagcacccccgagaucgccaccagacccaaggugaacggccagggcggcagaauggaguucagcuggacccugcuggacaugugggacaccaucaacuucgagagcaccggcaaccugaucgcccccgaguacggcuucaagaucagcaagagaggcagcagcggcaucaugaagaccgagggcacccuggagaacugcgagaccaagugccagaccccccugggcgccaucaacaccacccugcccuuccacaacgugcacccccugaccaucggcgagugccccaaguacgugaagagcgagaagcuggugcuggccaccggccugagaaacgugccccagaucgagagcagaggccuguucggcgccaucgccggcuucaucgagggcggcuggcagggcaugguggacggcugguacggcuaccaccacagcaacgaccagggcagcggcuacgccgccgacaaggagagcacccagaaggccuucgacggcaucaccaacaaggugaacagcgugaucgagaagaugaacacccaguucgaggccgugggcaaggaguucagcaaccuggagagaagacuggagaaccugaacaagaagguggaggacggcuuccuggacguguggaccuacaacgccgagcugcuggugcugauggagaacgagagaacccuggacuuccacgacagcaacgugaagaaccuguacgacaaggugagaaugcagcugagagacaacgugaaggagcugggcaacggcugcuucgaguucuaccacaagugcgacgacgagugcaugaacagcgugaagaacggcaccuacgacuaccccaaguacgaggaggagagcaagcugaacagaaacgagaucaagggcgugaagcugagcagcaugggcguguaccagauccuggccaucuacgccaccguggccggcagccugagccuggccaucaugauggccggcaucagcuucuggaugugcagcaacggcagccugcagugcagaaucugcaucuga

SEQ ID NO: 159125 - RNA, 1698 nt, Artificial Sequence
  derived and/or modified sequence opt4 from hemagglutinin__InfluenzaA__AEA10292
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugcagccugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccgugaagaacggccuguaccccaaccugagcaagagcuacgccaacaacaaggagaaggaggugcuggugcuguggggcgugcaccacccccccaacaucguggaccagaagacccuguacagaaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagacccccagaggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 159126 - RNA, 1701 nt, Artificial Sequence; identical to SEQ ID NO: 157788
  derived and/or modified sequence opt4 from hemagglutinin__InfluenzaA__AEA10303

SEQ ID NO: 159127 - RNA, 1701 nt, Artificial Sequence; identical to SEQ ID NO: 158642
  derived and/or modified sequence opt4 from hemagglutinin__InfluenzaA__AEA10313

SEQ ID NO: 159128 - RNA, 1701 nt, Artificial Sequence; identical to SEQ ID NO: 156353
  derived and/or modified sequence opt4 from hemagglutinin__InfluenzaA__AEA10323

SEQ ID NO: 159129 - RNA, 1701 nt, Artificial Sequence; identical to SEQ ID NO: 156741
  derived and/or modified sequence opt4 from hemagglutinin__InfluenzaA__AEA10339

SEQ ID NO: 159130 - RNA, 1701 nt, Artificial Sequence
  derived and/or modified sequence opt4 from hemagglutinin__InfluenzaA__AEA10349
augaaggccauccugaucgugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159131 - RNA, 1701 nt, Artificial Sequence; identical to SEQ ID NO: 156786
  derived and/or modified sequence opt4 from hemagglutinin__InfluenzaA__AEA30293

SEQ ID NO: 159132 - RNA, 1701 nt, Artificial Sequence
  derived and/or modified sequence opt4 from hemagglutinin__InfluenzaA__AEA48989
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgagagcaacaagggcgugaccgccgccugcccccacgccggcgccagaagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159133 - RNA, 1707 nt, Artificial Sequence
  derived and/or modified sequence opt4 from hemagglutinin__InfluenzaA__AEA50985
auggagaagaucgugcugcugcuggccaucaucaaccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguuccugaacgugcccgaguggagcuacaucguggagaagaucaaccccgccaacgaccugugcuaccccggcaacuucaacgacuacgaggagcugaagcaccugcugagcagaaucaaccacuucgagaagauccagaucauccccaagagcagcuggagcgaccacgaggccagcagcggcgugagcagcgccugccccuaccagggcagaagcagcuucuucagaaacgugguguggcugaucaagaagaacgacgccuaccccaccaucaagaucagcuacaacaacaccaaccaggaggaccugcuggugcuguggggcauccaccaccccaacgacgccgccgagcagaccaagcuguaccagaaccccaccaccuacaucagcgugggcaccagcacccugaaccugagacuggugcccaagaucgccaccagaagcaaggugaacggccagagcggcagaauggaguucuucuggaccauccugaagcccaacgacgccaucaacuucgagagcaacggcaacuucaucgcccccgagaacgccuacaagaucgugaagaagggcgacagcaccaucaugaagagcgagcuggaguacggcaacugcaacaccaagugccagacccccgugggcgccaucaacagcagcaugcccuuccacaacauccacccccugaccaucggcgagugccccaaguacgugaagagcaacagacuggugcuggccaccggccugagaaacagcccccagggcgagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucaacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacaacgagugcauggagagcgugagaaacggcaccuacgacuacccccaguacagcgaggagagcagacugaagagagaggagaucagcggcgugaagcuggagagcaucggcaucuaccagauccugagcaucuacagcaccgccgccagcagccuggcccuggccaucaugguggccggccugagccuguggaugugcagcaacggcagccugcagugcagaaucugcaucuga

SEQ ID NO: 159134 - RNA, 1701 nt, Artificial Sequence; identical to SEQ ID NO: 158053
  derived and/or modified sequence opt4 from hemagglutinin__InfluenzaA__AEA72704

SEQ ID NO: 159135 - RNA, 1701 nt, Artificial Sequence; identical to SEQ ID NO: 158053
  derived and/or modified sequence opt4 from hemagglutinin__InfluenzaA__AEA72715

SEQ ID NO: 159136 - RNA, 1701 nt, Artificial Sequence; identical to SEQ ID NO: 158053
  derived and/or modified sequence opt4 from hemagglutinin__InfluenzaA__AEA72726

SEQ ID NO: 159137 - RNA, 1701 nt, Artificial Sequence
  derived and/or modified sequence opt4 from hemagglutinin__InfluenzaA__AEA72740
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaccagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159138 - RNA, 1701 nt, Artificial Sequence
  derived and/or modified sequence opt4 from hemagglutinin__InfluenzaA__AEA72750
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcguguucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159139 - RNA, 1701 nt, Artificial Sequence; identical to SEQ ID NO: 158955
  derived and/or modified sequence opt4 from hemagglutinin__InfluenzaA__AEA72759

SEQ ID NO: 159140 - RNA, 1701 nt, Artificial Sequence
  derived and/or modified sequence opt4 from hemagglutinin__InfluenzaA__AEA72777
augaaggccauccugguggugcugcuguacacccuggccaccgccaacgccgacacccugugcaucggcuaccacgccaacaacagcaccgacaccguggacaccgugcuggagaagaacgugaccgugacccacagcgugaaccugcuggaggacaagcacgacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggagauccuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacgccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159141 - RNA, 1701 nt, Artificial Sequence; identical to SEQ ID NO: 158955
  derived and/or modified sequence opt4 from hemagglutinin__InfluenzaA__AEA72787

SEQ ID NO: 159142 - RNA, 1701 nt, Artificial Sequence; identical to SEQ ID NO: 158053
  derived and/or modified sequence opt4 from hemagglutinin__InfluenzaA__AEA73288

SEQ ID NO: 159143 - RNA, 1701 nt, Artificial Sequence; identical to SEQ ID NO: 158053
  derived and/or modified sequence opt4 from hemagglutinin__InfluenzaA__AEA73299

SEQ ID NO: 159144 - RNA, 1701 nt, Artificial Sequence; identical to SEQ ID NO: 158053
  derived and/or modified sequence opt4 from hemagglutinin__InfluenzaA__AEA73310

SEQ ID NO: 159145 - RNA, 1701 nt, Artificial Sequence
  derived and/or modified sequence opt4 from hemagglutinin__InfluenzaA__AEA73321
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcuggugacccuggagaaccagcacaccaucgaccugaccgacagcgagaugaacaagcuguucgagaagaccaagaagcagcugagagagaacgccgaggacaugggcaacggcugcuucaccaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 159146 - RNA, 1701 nt, Artificial Sequence; identical to SEQ ID NO: 158053
  derived and/or modified sequence opt4 from hemagglutinin__InfluenzaA__AEA73332

SEQ ID NO: 159147 - RNA, 1701 nt, Artificial Sequence; identical to SEQ ID NO: 158053
  derived and/or modified sequence opt4 from hemagglutinin__InfluenzaA__AEA73343

SEQ ID NO: 159148 - RNA, 1701 nt, Artificial Sequence; identical to SEQ ID NO: 158053
  derived and/or modified sequence opt4 from hemagglutinin__InfluenzaA__AEA73354

SEQ ID NO: 159149 - RNA, 1701 nt, Artificial Sequence
  derived and/or modified sequence opt4 from hemagglutinin__InfluenzaA__AEA73365
augaagaccaucaucgcccugagcuacacccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaccaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 159150 - RNA, 1701 nt, Artificial Sequence; identical to SEQ ID NO: 158053
  derived and/or modified sequence opt4 from hemagglutinin__InfluenzaA__AEA73376

SEQ ID NO: 159151 - RNA, 1701 nt, Artificial Sequence; identical to SEQ ID NO: 158053
  derived and/or modified sequence opt4 from hemagglutinin__InfluenzaA__AEA73387

SEQ ID NO: 159152 - RNA, 1701 nt, Artificial Sequence; identical to SEQ ID NO: 158053
  derived and/or modified sequence opt4 from hemagglutinin__InfluenzaA__AEA73398

SEQ ID NO: 159153 - RNA, 1701 nt, Artificial Sequence; identical to SEQ ID NO: 158053
  derived and/or modified sequence opt4 from hemagglutinin__InfluenzaA__AEA73409

SEQ ID NO: 159154 - RNA, 1701 nt, Artificial Sequence; identical to SEQ ID NO: 158053
  derived and/or modified sequence opt4 from hemagglutinin__InfluenzaA__AEA73420

SEQ ID NO: 159155 - RNA, 1701 nt, Artificial Sequence; identical to SEQ ID NO: 158053
  derived and/or modified sequence opt4 from hemagglutinin__InfluenzaA__AEA73452

SEQ ID NO: 159156 - RNA, 1701 nt, Artificial Sequence; identical to SEQ ID NO: 158053
  derived and/or modified sequence opt4 from hemagglutinin__InfluenzaA__AEA73463

SEQ ID NO: 159157 - RNA, 1701 nt, Artificial Sequence; identical to SEQ ID NO: 158053
  derived and/or modified sequence opt4 from hemagglutinin__InfluenzaA__AEA73474

SEQ ID NO: 159158 - RNA, 1701 nt, Artificial Sequence
  derived and/or modified sequence opt4 from hemagglutinin__InfluenzaA__AEA73485
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaccaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 159159 - RNA, 1701 nt, Artificial Sequence; identical to SEQ ID NO: 158053
  derived and/or modified sequence opt4 from hemagglutinin__InfluenzaA__AEA73496

SEQ ID NO: 159160 - RNA, 1701 nt, Artificial Sequence; identical to SEQ ID NO: 158053
  derived and/or modified sequence opt4 from hemagglutinin__InfluenzaA__AEA73507

SEQ ID NO: 159161 - RNA, 1701 nt, Artificial Sequence; identical to SEQ ID NO: 158053
  derived and/or modified sequence opt4 from hemagglutinin__InfluenzaA__AEA73518

SEQ ID NO: 159162 - RNA, 1701 nt, Artificial Sequence; identical to SEQ ID NO: 158053
  derived and/or modified sequence opt4 from hemagglutinin__InfluenzaA__AEA73529

SEQ ID NO: 159163 - RNA, 1701 nt, Artificial Sequence; identical to SEQ ID NO: 158053
  derived and/or modified sequence opt4 from hemagglutinin__InfluenzaA__AEA73540

SEQ ID NO: 159164 - RNA, 1701 nt, Artificial Sequence; identical to SEQ ID NO: 158053
  derived and/or modified sequence opt4 from hemagglutinin__InfluenzaA__AEA73551

SEQ ID NO: 159165 - RNA, 1701 nt, Artificial Sequence; identical to SEQ ID NO: 158053
  derived and/or modified sequence opt4 from hemagglutinin__InfluenzaA__AEA73562

SEQ ID NO: 159166 - RNA, 1698 nt, Artificial Sequence
  derived and/or modified sequence opt4 from hemagglutinin__InfluenzaA__AEA73573
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccgagaagaacggccuguaccccaaccugagcaagagcuacgccaacaacaaggagaaggaggugcuggugcuguggggcgugcaccacccccccaacaucggcgaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 159167 - RNA, 1698 nt, Artificial Sequence
  derived and/or modified sequence opt4 from hemagglutinin__InfluenzaA__AEA73584
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucguggaccagaagacccuguacagaaccgagaacgccuacgugagcguggugagcagccacuacagcagaaaguucacccccgagaucgccaagagacccaaggugagaaaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 159168 - RNA, 1698 nt, Artificial Sequence
  derived and/or modified sequence opt4 from hemagglutinin__InfluenzaA__AEA73595
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccgugaagaacggccuguaccccaaccugagcaagagcuacgccaacaacaaggagaaggaggugcuggugcuguggggcgugcaccacccccccaacaucguggaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagacccccagaggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 159169 - RNA, 1698 nt, Artificial Sequence; identical to SEQ ID NO: 158473
  derived and/or modified sequence opt4 from hemagglutinin__InfluenzaA__AEA73606

SEQ ID NO: 159170 - RNA, 1698 nt, Artificial Sequence; identical to SEQ ID NO: 155651
  derived and/or modified sequence opt4 from hemagglutinin__InfluenzaA__AEA73617

SEQ ID NO: 159171 - RNA, 1698 nt, Artificial Sequence; identical to SEQ ID NO: 156136
  derived and/or modified sequence opt4 from hemagglutinin__InfluenzaA__AEA73628

SEQ ID NO: 159172 - RNA, 1698 nt, Artificial Sequence; identical to SEQ ID NO: 158492
  derived and/or modified sequence opt4 from hemagglutinin__InfluenzaA__AEA73639

SEQ ID NO: 159173 - RNA, 1698 nt, Artificial Sequence; identical to SEQ ID NO: 155651
  derived and/or modified sequence opt4 from hemagglutinin__InfluenzaA__AEA73650

SEQ ID NO: 159174 - RNA, 1698 nt, Artificial Sequence; identical to SEQ ID NO: 156136
  derived and/or modified sequence opt4 from hemagglutinin__InfluenzaA__AEA73661

SEQ ID NO: 159175 - RNA, 1698 nt, Artificial Sequence
  derived and/or modified sequence opt4 from hemagglutinin__InfluenzaA__AEA73672
augaaggugaagcugcuggugcugcugugcaccuucaccgccaccuucgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccgugaagaacggccuguaccccaaccugagcaagagcuacgccaacaacaaggagaaggaggugcuggugcuguggggcgugcaccacccccccaacaucguggaccagaagacccuguacagaaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagacccccagaggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 159176 - RNA, 1698 nt, Artificial Sequence; identical to SEQ ID NO: 156136
  derived and/or modified sequence opt4 from hemagglutinin__InfluenzaA__AEA73683

SEQ ID NO: 159177 - RNA, 1698 nt, Artificial Sequence
  derived and/or modified sequence opt4 from hemagglutinin__InfluenzaA__AEA73694
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccgugaagaacggccuguaccccaaccugagcaagagcuacgccaacaacaaggagaaggaggugcuggugcuguggggcgugcaccacccccccaacaucguggaccagaagacccuguacagaaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagacccccagaggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcguggagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 159178 - RNA, 1698 nt, Artificial Sequence; identical to SEQ ID NO: 156136
  derived and/or modified sequence opt4 from hemagglutinin__InfluenzaA__AEA73705

SEQ ID NO: 159179 - RNA, 1698 nt, Artificial Sequence; identical to SEQ ID NO: 155651
  derived and/or modified sequence opt4 from hemagglutinin__InfluenzaA__AEA73716

SEQ ID NO: 159180 - RNA, 1698 nt, Artificial Sequence; identical to SEQ ID NO: 155651
  derived and/or modified sequence opt4 from hemagglutinin__InfluenzaA__AEA73727

SEQ ID NO: 159181 - RNA, 1698 nt, Artificial Sequence; identical to SEQ ID NO: 155651
  derived and/or modified sequence opt4 from hemagglutinin__InfluenzaA__AEA73738

SEQ ID NO: 159182 - RNA, 1698 nt, Artificial Sequence; identical to SEQ ID NO: 155651
  derived and/or modified sequence opt4 from hemagglutinin__InfluenzaA__AEA73749

SEQ ID NO: 159183 - RNA, 1698 nt, Artificial Sequence
  derived and/or modified sequence opt4 from hemagglutinin__InfluenzaA__AEA73760
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccgugaagaacggccuguaccccaaccugagcaagagcuacgccaacaacaaggagaaggaggugcuggugcuguggggcgugcaccacccccccaacaucguggaccagaagacccuguacagaaccgagaacgccuacgugagcguggugagcagccacuacagcagaaaguucacccccgagaucgccaagagacccaagaucagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagacccccagaggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 159184 - RNA, 1701 nt, Artificial Sequence; identical to SEQ ID NO: 155189
  derived and/or modified sequence opt4 from hemagglutinin__InfluenzaA__AEA73771

SEQ ID NO: 159185 - RNA, 1701 nt, Artificial Sequence; identical to SEQ ID NO: 156819
  derived and/or modified sequence opt4 from hemagglutinin__InfluenzaA__AEA73781

SEQ ID NO: 159186 - RNA, 1701 nt, Artificial Sequence; identical to SEQ ID NO: 156741
  derived and/or modified sequence opt4 from hemagglutinin__InfluenzaA__AEA73791

SEQ ID NO: 159187 - RNA, 1701 nt, Artificial Sequence; identical to SEQ ID NO: 155369
  derived and/or modified sequence opt4 from hemagglutinin__InfluenzaA__AEA73801

SEQ ID NO: 159188 - RNA, 1701 nt, Artificial Sequence; identical to SEQ ID NO: 156353
  derived and/or modified sequence opt4 from hemagglutinin__InfluenzaA__AEA73811

SEQ ID NO: 159189 - RNA, 1701 nt, Artificial Sequence; identical to SEQ ID NO: 156911
  derived and/or modified sequence opt4 from hemagglutinin__InfluenzaA__AEA73821

SEQ ID NO: 159190 - RNA, 1701 nt, Artificial Sequence
  derived and/or modified sequence opt4 from hemagglutinin__InfluenzaA__AEA73831
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcgugaccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcaccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159191 - RNA, 1701 nt, Artificial Sequence
  derived and/or modified sequence opt4 from hemagglutinin__InfluenzaA__AEA73841
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccgagagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugguggagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159192 - RNA, 1701 nt, Artificial Sequence; identical to SEQ ID NO: 156819
  derived and/or modified sequence opt4 from hemagglutinin__InfluenzaA__AEA73851

SEQ ID NO: 159193 - RNA, 1701 nt, Artificial Sequence
  derived and/or modified sequence opt4 from hemagglutinin__InfluenzaA__AEA73861
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcgagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacgugcaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagaucgacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159194 - RNA, 1701 nt, Artificial Sequence; identical to SEQ ID NO: 157061
  derived and/or modified sequence opt4 from hemagglutinin__InfluenzaA__AEA73871

SEQ ID NO: 159195 - RNA, 1701 nt, Artificial Sequence; identical to SEQ ID NO: 157061
  derived and/or modified sequence opt4 from hemagglutinin__InfluenzaA__AEA73881

SEQ ID NO: 159196 - RNA, 1701 nt, Artificial Sequence; identical to SEQ ID NO: 156741
  derived and/or modified sequence opt4 from hemagglutinin__InfluenzaA__AEA73891

SEQ ID NO: 159197 - RNA, 1701 nt, Artificial Sequence
  derived and/or modified sequence opt4 from hemagglutinin__InfluenzaA__AEA73901
augaacgccauccugguggugcugcuguacaccuucgccaccgccaacgccgacacccugugcaucggcuaccacgccaacaacagcaccgacaccguggacacccugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaagaucaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159198 - RNA, 1701 nt, Artificial Sequence; identical to SEQ ID NO: 156353
  derived and/or modified sequence opt4 from hemagglutinin__InfluenzaA__AEA73911

SEQ ID NO: 159199 - RNA, 1701 nt, Artificial Sequence; identical to SEQ ID NO: 157061
  derived and/or modified sequence opt4 from hemagglutinin__InfluenzaA__AEA73921

SEQ ID NO: 159200 - RNA, 1701 nt, Artificial Sequence; identical to SEQ ID NO: 156819
  derived and/or modified sequence opt4 from hemagglutinin__InfluenzaA__AEA73931

SEQ ID NO: 159201 - RNA, 1701 nt, Artificial Sequence; identical to SEQ ID NO: 156819
  derived and/or modified sequence opt4 from hemagglutinin__InfluenzaA__AEA73961

SEQ ID NO: 159202 - RNA, 1701 nt, Artificial Sequence
  derived and/or modified sequence opt4 from hemagglutinin__InfluenzaA__AEA73971
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccacagcaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcaacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159203 - RNA, 1701 nt, Artificial Sequence; identical to SEQ ID NO: 156819
  derived and/or modified sequence opt4 from hemagglutinin__InfluenzaA__AEA73981

SEQ ID NO: 159204 - RNA, 1701 nt, Artificial Sequence
  derived and/or modified sequence opt4 from hemagglutinin__InfluenzaA__AEA73991
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagaaguucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacagcuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159205 - RNA, 1701 nt, Artificial Sequence; identical to SEQ ID NO: 156802
  derived and/or modified sequence opt4 from hemagglutinin__InfluenzaA__AEA74001

SEQ ID NO: 159206 - RNA, 1701 nt, Artificial Sequence
  derived and/or modified sequence opt4 from hemagglutinin__InfluenzaA__AEA74011
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagagaaacagcuaccccaagcugagccagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcaucaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159207 - RNA, 1701 nt, Artificial Sequence
  derived and/or modified sequence opt4 from hemagglutinin__InfluenzaA__AEA74021
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagccagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcaucaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159208 - RNA, 1701 nt, Artificial Sequence
  derived and/or modified sequence opt4 from hemagglutinin__InfluenzaA__AEA74031
augaaggccauccugguggugcugcuguacaccuucgccaccgccaacgccgacacccugugcaucggcuaccacgccaacaacagcaccgacaccguggacaccgugcuggagaagaacgugaccgugacccacagcguggaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaacaaccugaucuggcuggugaagaagggcaacagcuaccccaagcugaacaagagcuacaucaacgacaagggcaaggaggugcuggugcuguggggcauccaccaccccagcaccagcaccgaccagcagagccuguaccagaacgccgacgccuacguguucgugggcaccagcagauacagcaagaaguucaagcccgagaucgccaucagacccaaggugagaaaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccauccacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159209 - RNA, 1701 nt, Artificial Sequence
  derived and/or modified sequence opt4 from hemagglutinin__InfluenzaA__AEA74035
augaaggccauccugguggugcugcuguacaccuucgccaccgccaacgccgacacccugugcaucggcuaccacgccaacaacagcaccgacaccguggacaccgugcuggagaagaacgugaccgugacccacagcguggaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaacaaccugaucuggcuggugaagaagggcaacagcuaccccaagcugaacaagagcuacaucaacgacaagggcaaggaggugcuggugcuguggggcauccaccaccccagcaccagcaccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccauccacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159210 - RNA, 1701 nt, Artificial Sequence; identical to SEQ ID NO: 154954
  derived and/or modified sequence opt4 from hemagglutinin__InfluenzaA__AEA77299

SEQ ID NO: 159211 - RNA, 1701 nt, Artificial Sequence; identical to SEQ ID NO: 158955
  derived and/or modified sequence opt4 from hemagglutinin__InfluenzaA__AEB21316

SEQ ID NO: 159212 - RNA, 1701 nt, Artificial Sequence; identical to SEQ ID NO: 158974
  derived and/or modified sequence opt4 from hemagglutinin__InfluenzaA__AEB21326

SEQ ID NO: 159213 - RNA, 1701 nt, Artificial Sequence; identical to SEQ ID NO: 158955
  derived and/or modified sequence opt4 from hemagglutinin__InfluenzaA__AEB21338

SEQ ID NO: 159214 - RNA, 1701 nt, Artificial Sequence; identical to SEQ ID NO: 158974
  derived and/or modified sequence opt4 from hemagglutinin__InfluenzaA__AEB21348

SEQ ID NO: 159215 - RNA, 1701 nt, Artificial Sequence; identical to SEQ ID NO: 156108
  derived and/or modified sequence opt4 from hemagglutinin__InfluenzaA__AEB40206

SEQ ID NO: 159216 - RNA, 1701 nt, Artificial Sequence; identical to SEQ ID NO: 156108
  derived and/or modified sequence opt4 from hemagglutinin__InfluenzaA__AEB66895

SEQ ID NO: 159217 - RNA, 1698 nt, Artificial Sequence
  derived and/or modified sequence opt4 from hemagglutinin__InfluenzaA__AEB71102
auggacgugcccguguucgugcugcugaugcugaccagcaucugcgugcaggccgacagaaucugcgugggcuaccugagcaccaacagcagcgagagaguggacacccugcuggagaacaacgugcccgugaccagcagcguggaccugguggagaccaaccacaccggcaccuacugcagccugggcggcaucagccccgugcaccugggcgacugcagcuucgagggcuggaucgugggcaaccccgccugcgccagcaaccugggcaucagagaguggagcuaccugaucgaggaccccagcgccccccacggccugugcuaccccggcgagcuggacaacaacggcgagcugagacaccuguucagcggcaucagaagcuucagcagaaccgagcugaucgcccccaccagcuggggcgaggugaacgacggcgugaccgccgccugccaggacaagggcgccagcagcuucuacagaaaccuggugugguucguggagagaggcaacaaguaccccgugaucagaagaaccuacaacaacaccaccggcagagacgugcuggugaucuggggcauccaccaccccgugagcaccgacgaggccagaaagcuguacgccaaggacaaccccuacacccuggugagcaccagcagcuggagcagaaaguacaaccuggagaccggcaccagacccggcuacaacggccagaagagcuggaccaagaucuacugguaccugaugcaccccggcgacagcaucagcuucgagagcaacggcggccugcuggcccccaaguacggcuacaucaucgaggaguacggcaagggcagaaucuuccagagcagaaucagaaucgccaagugcaacaccaagugccagaccagcgugggcggcaucaacaccaacaagaccuuccagaacaucgagagaaacgcccugggcgacugccccaaguacaucaagagcggccagcugaagcuggccaccggccugagaaacgugcccgccaucagcaacagaggccuguucggcgccaucgccggcuucaucgagggcggcuggcccggccugaucaacggcugguacggcuuccagcaccagaacgagcagggcaugggcauggccgccgacaaggagagcacccagaaggccaucgaccagaucaccaccaagaucaacaacaucaucgagaagaugaacggcaacuacgacagcaucagaggcgaguucagccagguggagcagagaaucaacaugcuggccgacagaaucgacgacgccgugaccgacguguggagcuacaacgccaagcugcuggugcugcuggagaacgacaagacccuggacaugcacgacgccaacgugagaaaccugcacgaccaggugagaagagugcugagaaccaacgccaucgacgagggcaacggcugcuucgagcugcugcacaagugcaacgacagcugcauggagaccaucagaaacggcaccuacaaccacaucgaguacgaggaggagagcaagcugaagagacaggagaucgagggcaucaagcugaagagcgacgacaacguguacaaggcccugagcaucuacagcugcaucgccagcagcaucgugcuggugggccugauccuggccuucaucaugugggccugcagcagcggcaacugcagauucaacaucugcaucuga

SEQ ID NO: 159218 - RNA, 1698 nt, Artificial Sequence
  derived and/or modified sequence opt4 from hemagglutinin__InfluenzaA__AEB71896
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucguggaccagaagacccuguacagaaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccaugggcaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacaaggagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 159219 - RNA, 1701 nt, Artificial Sequence; identical to SEQ ID NO: 155431
  derived and/or modified sequence opt4 from hemagglutinin__InfluenzaA__AEB71916

SEQ ID NO: 159220 - RNA, 1701 nt, Artificial Sequence; identical to SEQ ID NO: 154954
  derived and/or modified sequence opt4 from hemagglutinin__InfluenzaA__AEB71925

SEQ ID NO: 159221 - RNA, 1701 nt, Artificial Sequence; identical to SEQ ID NO: 154954
  derived and/or modified sequence opt4 from hemagglutinin__InfluenzaA__AEB71936

SEQ ID NO: 159222 - RNA, 1701 nt, Artificial Sequence; identical to SEQ ID NO: 154954
  derived and/or modified sequence opt4 from hemagglutinin__InfluenzaA__AEB71947

SEQ ID NO: 159223 - RNA, 1698 nt, Artificial Sequence; identical to SEQ ID NO: 158492
  derived and/or modified sequence opt4 from hemagglutinin__InfluenzaA__AEB71958

SEQ ID NO: 159224 - RNA, 1701 nt, Artificial Sequence; identical to SEQ ID NO: 157939
  derived and/or modified sequence opt4 from hemagglutinin__InfluenzaA__AEB71969

SEQ ID NO: 159225 - RNA, 1701 nt, Artificial Sequence
  derived and/or modified sequence opt4 from hemagglutinin__InfluenzaA__AEB71980
augaagaccaucaucgcccugagcugcauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 159226 - RNA, 1698 nt, Artificial Sequence; identical to SEQ ID NO: 156136
  derived and/or modified sequence opt4 from hemagglutinin__InfluenzaA__AEB71992

SEQ ID NO: 159227 - RNA, 1698 nt, Artificial Sequence; identical to SEQ ID NO: 156136
  derived and/or modified sequence opt4 from hemagglutinin__InfluenzaA__AEC13313

SEQ ID NO: 159228 - RNA, 1701 nt, Artificial Sequence
  derived and/or modified sequence opt4 from hemagglutinin__InfluenzaA__AEC46553
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgaccccaacaagggcgugaccgccgccugcccccacgccggcgccaagagcuucuacaagaaccugaucuggcuggugaagaagggcaacagcuaccccaagcugagcaccagcuacaucaacgacaagggcaaggaggugcuggugcuguggggcauccaccaccccagcaccagcgccgaccagcagagccuguaccagaacgccgacgccuacgccuucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacaccagcgugcacgacugcaacaccaccugccagacccccaagggcgccaucaacaccagccugcccuuccagaacgugcaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccuucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159229 - RNA, 1701 nt, Artificial Sequence
  derived and/or modified sequence opt4 from hemagglutinin__InfluenzaA__AEC46555
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgaccccaacaagggcgugaccgccgccugcccccacgccggcgccaagagcuucuacaagaaccugaucuggcuggugaagaagggcaacagcuaccccaagcugagcaccagcuacaucaacgacaagggcaagaaggugcuggugcuguggggcauccaccaccccagcaccagcgccgaccagcagagccuguaccagaacgccgacgccuacgccuucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgagggcagcggcaucaucaucagcgacaccagcgugcacgacugcaacaccaccugccagacccccaagggcgccaucaacaccagccugcccuuccagaacgugcaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccuucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159230 - RNA, 1701 nt, Artificial Sequence; identical to SEQ ID NO: 159228
  derived and/or modified sequence opt4 from hemagglutinin__InfluenzaA__AEC46557

SEQ ID NO: 159231 - RNA, 1701 nt, Artificial Sequence; identical to SEQ ID NO: 155176
  derived and/or modified sequence opt4 from hemagglutinin__InfluenzaA__AEC53259

SEQ ID NO: 159232 - RNA, 1701 nt, Artificial Sequence
  derived and/or modified sequence opt4 from hemagglutinin__InfluenzaA__AEC53269
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcugcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159233 - RNA, 1701 nt, Artificial Sequence; identical to SEQ ID NO: 155919
  derived and/or modified sequence opt4 from hemagglutinin__InfluenzaA__AEC53279

SEQ ID NO: 159234 - RNA, 1701 nt, Artificial Sequence; identical to SEQ ID NO: 155176
  derived and/or modified sequence opt4 from hemagglutinin__InfluenzaA__AEC53289

SEQ ID NO: 159235 - RNA, 1701 nt, Artificial Sequence; identical to SEQ ID NO: 155176
  derived and/or modified sequence opt4 from hemagglutinin__InfluenzaA__AEC53299

SEQ ID NO: 159236 - RNA, 1701 nt, Artificial Sequence; identical to SEQ ID NO: 155369
  derived and/or modified sequence opt4 from hemagglutinin__InfluenzaA__AEC53327

SEQ ID NO: 159237 - RNA, 1701 nt, Artificial Sequence
  derived and/or modified sequence opt4 from hemagglutinin__InfluenzaA__AEC53347
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugaucgagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159238 - RNA, 1701 nt, Artificial Sequence
  derived and/or modified sequence opt4 from hemagglutinin__InfluenzaA__AEC53404
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcaucaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159239 - RNA, 1701 nt, Artificial Sequence; identical to SEQ ID NO: 155176
  derived and/or modified sequence opt4 from hemagglutinin__InfluenzaA__AEC53414

SEQ ID NO: 159240 - RNA, 1701 nt, Artificial Sequence
  derived and/or modified sequence opt4 from hemagglutinin__InfluenzaA__AEE27177
augaagaccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagagaaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159241 - RNA, 1701 nt, Artificial Sequence; identical to SEQ ID NO: 156961
  derived and/or modified sequence opt4 from hemagglutinin__InfluenzaA__AEE27187

SEQ ID NO: 159242 - RNA, 1701 nt, Artificial Sequence
  derived and/or modified sequence opt4 from hemagglutinin__InfluenzaA__AEE27207
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaaggugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159243 - RNA, 1701 nt, Artificial Sequence
  derived and/or modified sequence opt4 from hemagglutinin__InfluenzaA__AEG64752
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugagaagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagacagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159244 - RNA, 1701 nt, Artificial Sequence
  derived and/or modified sequence opt4 from hemagglutinin__InfluenzaA__AEG64762
augaaggccagacugcuggugcugcugugcgcccuggccgccaccgacgccgacaccaucugcaucggcuaccacgccaacaacagcaccgacaccguggacacccugcuggagaagaacgugaccgugacccacagcgugaaccugcuggaggacagccacaacggcaagcugugcaagcugaagggcaucgccccccugcagcugggcaagugcaacaucgccggcuggcugcugggcaaccccgagugcgacagccugcugcccgccagaagcuggagcuacaucguggagacccccaacagcgagaacggcgccugcuaccccggcgacuucaucgacuacgaggagcugagagagcagcugagcaccgugagcagccuggagagauucgagaucuuccccaaggagagcagcuggcccaaccacaacacccugaagggcgugaccgugagcugcagccacggcggcaagagcagcuucuacagaaaccugcuguggcugaccaagaccggcgacagcuaccccaagcugaacaacagcuacgugaacaacaagggcaaggaggugcuggugcuguggggcgugcaccaccccagcagcagcaacgagcagcagagccuguaccacaacgugaacgccuacgugagcguggugagcagcaacuacaacagaagauucacccccgagaucgccgccagacccaaggugagagaccagcccggcagaaugaacuacuacuggacccugcuggagcccggcgacaccauccuguucgaggccaccggcaaccugaucgcccccugguacgccuucgcccugagcagaggcuucggcagcggcaucaucaccagcaacgccagcaugcacgagugcaacaccaagugccagaccccccagggcgccaucaacagcagccugcccuuccagaacauccaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaaccuggagaagagaauggagaaccugaacaagaagguggacgacggcuuccuggacaucuggaccuacaacgccgagcugcuggugcugcuggagaacgagagaacccuggacuuccacgaccugaacgugaagaaccuguacgagaaggugaagagccagcugaagaacaacgccaaggagaucggcaacggcugcuucgaguucuaccacaagugcgacaacgagugcauggagagcgugagagacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 159245 - RNA, 1701 nt, Artificial Sequence; identical to SEQ ID NO: 155189
  derived and/or modified sequence opt4 from hemagglutinin__InfluenzaA__AEG64784

SEQ ID NO: 159246 - RNA, 1701 nt, Artificial Sequence
  derived and/or modified sequence opt4 from hemagglutinin__InfluenzaA__AEG64834
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcgccggcgagaucugcgacagcccccaccagauccuggacggcgagaacugcacccugaucgacgcccugcugggcgacccccagugcgacggcuuccagaacaagaagugggaccuguucguggagagaagcagagccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 159247 - RNA, 1701 nt, Artificial Sequence
  derived and/or modified sequence opt4 from hemagglutinin__InfluenzaA__AEG64845
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 159248 - RNA, 1701 nt, Artificial Sequence
  derived and/or modified sequence opt4 from hemagglutinin__InfluenzaA__AEG64856
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcgugaugagaagcgacgccagcaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucgagagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 159249 - RNA, 1701 nt, Artificial Sequence; identical to SEQ ID NO: 152592
  derived and/or modified sequence opt4 from hemagglutinin__InfluenzaA__AEG64867

SEQ ID NO: 159250 - RNA, 1701 nt, Artificial Sequence
  derived and/or modified sequence opt4 from hemagglutinin__InfluenzaA__AEG64878
augaagaccaucaucgcccugagcuacauccugugccugguguucgcccagaagcugcccgugaacgacaacagcaccgccacccugugccugggccaccacgccgugcccaacggcacccuggugaagaccaucaccaacgaccacaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaccgccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcaacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 159251 - RNA, 1701 nt, Artificial Sequence
  derived and/or modified sequence opt4 from hemagglutinin__InfluenzaA__AEG64889
augaagaccaucaucgcccugagcuacauccugugccugguguucgcccagaagcugcccgugaacgacaacagcaccgccacccugugccugggccaccacgccgugcccaacggcacccuggugaagaccaucaccaacgaccacaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaccgccuacagcaacugcuaccccuacgacgugcccgacuacgccagccugagaagccuguucgccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcaacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 159252 - RNA, 1701 nt, Artificial Sequence; identical to SEQ ID NO: 152552
  derived and/or modified sequence opt4 from hemagglutinin__InfluenzaA__AEG64911

SEQ ID NO: 159253 - RNA, 1701 nt, Artificial Sequence; identical to SEQ ID NO: 152552
  derived and/or modified sequence opt4 from hemagglutinin__InfluenzaA__AEG64922

SEQ ID NO: 159254 - RNA, 1701 nt, Artificial Sequence; identical to SEQ ID NO: 152552
  derived and/or modified sequence opt4 from hemagglutinin__InfluenzaA__AEG64933

SEQ ID NO: 159255 - RNA, 1701 nt, Artificial Sequence; identical to SEQ ID NO: 152638
  derived and/or modified sequence opt4 from hemagglutinin__InfluenzaA__AEG64944

SEQ ID NO: 159256 - RNA, 1701 nt, Artificial Sequence; identical to SEQ ID NO: 152552
  derived and/or modified sequence opt4 from hemagglutinin__InfluenzaA__AEG64955

SEQ ID NO: 159257 - RNA, 1701 nt, Artificial Sequence; identical to SEQ ID NO: 152552
  derived and/or modified sequence opt4 from hemagglutinin__InfluenzaA__AEG64966

SEQ ID NO: 159258 - RNA, 1701 nt, Artificial Sequence
  derived and/or modified sequence opt4 from hemagglutinin__InfluenzaA__AEG64977
augaagaccaucaucgcccugagcuacauccugugccugguguucgcccagaagcugcccgagaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucgacaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 159259 - RNA, 1701 nt, Artificial Sequence
  derived and/or modified sequence opt4 from hemagglutinin__InfluenzaA__AEG64988
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacaugccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 159260 - RNA, 1701 nt, Artificial Sequence
  derived and/or modified sequence opt4 from hemagglutinin__InfluenzaA__AEG64999
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgugagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 159261 - RNA, 1701 nt, Artificial Sequence; identical to SEQ ID NO: 152775
  derived and/or modified sequence opt4 from hemagglutinin__InfluenzaA__AEG65010

SEQ ID NO: 159262 - RNA, 1701 nt, Artificial Sequence
  derived and/or modified sequence opt4 from hemagglutinin__InfluenzaA__AEG65021
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgugagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaccgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 159263 - RNA, 1701 nt, Artificial Sequence
  derived and/or modified sequence opt4 from hemagglutinin__InfluenzaA__AEG65032
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacaagcugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 159264 - RNA, 1701 nt, Artificial Sequence; identical to SEQ ID NO: 153150
  derived and/or modified sequence opt4 from hemagglutinin__InfluenzaA__AEG65043

SEQ ID NO: 159265 - RNA, 1701 nt, Artificial Sequence; identical to SEQ ID NO: 153150
  derived and/or modified sequence opt4 from hemagglutinin__InfluenzaA__AEG65054

SEQ ID NO: 159266 - RNA, 1701 nt, Artificial Sequence
  derived and/or modified sequence opt4 from hemagglutinin__InfluenzaA__AEG65065
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacugggugcuguggaucagcuucgccaucagcugcuuccugcugugcguggugcugcugggcuucaucaugugggccugccagaagggcaacaucagaugcaacaucugcaucuga

SEQ ID NO: 159267 - RNA, 1701 nt, Artificial Sequence
  derived and/or modified sequence opt4 from hemagglutinin__InfluenzaA__AEG65076
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugagauucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacgugggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 159268 - RNA, 1701 nt, Artificial Sequence
  derived and/or modified sequence opt4 from hemagglutinin__InfluenzaA__AEG65087
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccaacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 159269 - RNA, 1701 nt, Artificial Sequence
  derived and/or modified sequence opt4 from hemagglutinin__InfluenzaA__AEG65098
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacgacuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccacagcaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaaccugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 159270 - RNA, 1701 nt, Artificial Sequence
  derived and/or modified sequence opt4 from hemagglutinin__InfluenzaA__AEG65109
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcaagcugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccagagcagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 159271 - RNA, 1701 nt, Artificial Sequence
  derived and/or modified sequence opt4 from hemagglutinin__InfluenzaA__AEG65120
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucgccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 159272 - RNA, 1701 nt, Artificial Sequence
  derived and/or modified sequence opt4 from hemagglutinin__InfluenzaA__AEG65131
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccacagcaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 159273 - RNA, 1701 nt, Artificial Sequence; identical to SEQ ID NO: 152571
  derived and/or modified sequence opt4 from hemagglutinin__InfluenzaA__AEG65142

SEQ ID NO: 159274 - RNA, 1701 nt, Artificial Sequence; identical to SEQ ID NO: 152571
  derived and/or modified sequence opt4 from hemagglutinin__InfluenzaA__AEG65153

SEQ ID NO: 159275 - RNA, 1701 nt, Artificial Sequence
  derived and/or modified sequence opt4 from hemagglutinin__InfluenzaA__AEG65164
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggccccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgaguuccugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 159276 - RNA, 1701 nt, Artificial Sequence
  derived and/or modified sequence opt4 from hemagglutinin__InfluenzaA__AEG65175
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcgagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcgacaucugcaucuga

SEQ ID NO: 159277 - RNA, 1701 nt, Artificial Sequence; identical to SEQ ID NO: 152939
  derived and/or modified sequence opt4 from hemagglutinin__InfluenzaA__AEG65186

SEQ ID NO: 159278 - RNA, 1701 nt, Artificial Sequence
  derived and/or modified sequence opt4 from hemagglutinin__InfluenzaA__AEG65197
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagccccaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacaucauccugaucaacagcaccggcaaccugaucgcccccagaggcuacuucaagaucagaagcggcaagagcagcaucaugagaagcgacacccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 159279 - RNA, 1701 nt, Artificial Sequence; identical to SEQ ID NO: 153150
  derived and/or modified sequence opt4 from hemagglutinin__InfluenzaA__AEG65208

SEQ ID NO: 159280 - RNA, 1701 nt, Artificial Sequence
  derived and/or modified sequence opt4 from hemagglutinin__InfluenzaA__AEG65219
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaagagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacgugcccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucaagugcaacaucugcaucuga

SEQ ID NO: 159281 - RNA, 1701 nt, Artificial Sequence; identical to SEQ ID NO: 154315
  derived and/or modified sequence opt4 from hemagglutinin__InfluenzaA__AEG65230

SEQ ID NO: 159282 - RNA, 1701 nt, Artificial Sequence; identical to SEQ ID NO: 154315
  derived and/or modified sequence opt4 from hemagglutinin__InfluenzaA__AEG65252

SEQ ID NO: 159283 - RNA, 1701 nt, Artificial Sequence; identical to SEQ ID NO: 153036
  derived and/or modified sequence opt4 from hemagglutinin__InfluenzaA__AEG65263

SEQ ID NO: 159284 - RNA, 1701 nt, Artificial Sequence; identical to SEQ ID NO: 153036
  derived and/or modified sequence opt4 from hemagglutinin__InfluenzaA__AEG65274

SEQ ID NO: 159285 - RNA, 1701 nt, Artificial Sequence; identical to SEQ ID NO: 153036
  derived and/or modified sequence opt4 from hemagglutinin__InfluenzaA__AEG65285

SEQ ID NO: 159286 - RNA, 1701 nt, Artificial Sequence
  derived and/or modified sequence opt4 from hemagglutinin__InfluenzaA__AEG65296
augaagaccgugaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgaccacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 159287 - RNA, 1701 nt, Artificial Sequence; identical to SEQ ID NO: 154315
  derived and/or modified sequence opt4 from hemagglutinin__InfluenzaA__AEG65307

SEQ ID NO: 159288 - RNA, 1701 nt, Artificial Sequence
  derived and/or modified sequence opt4 from hemagglutinin__InfluenzaA__AEG65318
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaagagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacgugcccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugagacagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 159289 - RNA, 1701 nt, Artificial Sequence; identical to SEQ ID NO: 154315
  derived and/or modified sequence opt4 from hemagglutinin__InfluenzaA__AEG65329

SEQ ID NO: 159290 - RNA, 1701 nt, Artificial Sequence
  derived and/or modified sequence opt4 from hemagglutinin__InfluenzaA__AEG65340
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcgagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucgagagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 159291 - RNA, 1701 nt, Artificial Sequence; identical to SEQ ID NO: 154315
  derived and/or modified sequence opt4 from hemagglutinin__InfluenzaA__AEG65351

SEQ ID NO: 159292 - RNA, 1701 nt, Artificial Sequence; identical to SEQ ID NO: 154315
  derived and/or modified sequence opt4 from hemagglutinin__InfluenzaA__AEG65362

SEQ ID NO: 159293 - RNA, 1701 nt, Artificial Sequence; identical to SEQ ID NO: 159290
  derived and/or modified sequence opt4 from hemagglutinin__InfluenzaA__AEG65373

SEQ ID NO: 159294 - RNA, 1701 nt, Artificial Sequence; identical to SEQ ID NO: 153036
  derived and/or modified sequence opt4 from hemagglutinin__InfluenzaA__AEG65384

SEQ ID NO: 159295 - RNA, 1701 nt, Artificial Sequence; identical to SEQ ID NO: 153036
  derived and/or modified sequence opt4 from hemagglutinin__InfluenzaA__AEG65406

SEQ ID NO: 159296 - RNA, 1701 nt, Artificial Sequence; identical to SEQ ID NO: 153036
  derived and/or modified sequence opt4 from hemagglutinin__InfluenzaA__AEG65417

SEQ ID NO: 159297 - RNA, 1701 nt, Artificial Sequence; identical to SEQ ID NO: 153036
  derived and/or modified sequence opt4 from hemagglutinin__InfluenzaA__AEG65428

SEQ ID NO: 159298 - RNA, 1701 nt, Artificial Sequence
  derived and/or modified sequence opt4 from hemagglutinin__InfluenzaA__AEG65439
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcgugggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 159299 - RNA, 1701 nt, Artificial Sequence
  derived and/or modified sequence opt4 from hemagglutinin__InfluenzaA__AEG65450
augaagaccaucaucgccuggagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugaucgccagcagcggcacccuggaguucaacaacgagagcuucaacuggaccggcgugacccagaacggcaccagcagcgccugcaagagaagaagcaacagcagcuucuucagcagacugaacuggcugacccaccugaaguucaaguaccccgcccugaacgugaccaugcccaacaacgaggaguucgacaagcuguacaucuggggcgugcaccaccccggcaccuacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 159300 - RNA, 1701 nt, Artificial Sequence; identical to SEQ ID NO: 159299
  derived and/or modified sequence opt4 from hemagglutinin__InfluenzaA__AEG65461

SEQ ID NO: 159301 - RNA, 1701 nt, Artificial Sequence
  derived and/or modified sequence opt4 from hemagglutinin__InfluenzaA__AEG65472
augaagaccaucaucgccuggagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugaucgccagcagcggcacccuggaguucaacaacgagagcuucaacuggaccggcgugacccagaacggcaccagcagcgccugcaagagaagaagcaacagcagcuucuucagcagacugaacuggcugacccaccugaaguucaaguaccccgcccugaacgugaccaugcccaacaacgaggaguucgacaagcuguacaucuggggcgugcaccaccccggcaccuacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaucaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 159302 - RNA, 1701 nt, Artificial Sequence; identical to SEQ ID NO: 159299
  derived and/or modified sequence opt4 from hemagglutinin__InfluenzaA__AEG65483

SEQ ID NO: 159303 - RNA, 1701 nt, Artificial Sequence; identical to SEQ ID NO: 159299
  derived and/or modified sequence opt4 from hemagglutinin__InfluenzaA__AEG65494

SEQ ID NO: 159304 - RNA, 1701 nt, Artificial Sequence; identical to SEQ ID NO: 159299
  derived and/or modified sequence opt4 from hemagglutinin__InfluenzaA__AEG65505

SEQ ID NO: 159305 - RNA, 1701 nt, Artificial Sequence; identical to SEQ ID NO: 159299
  derived and/or modified sequence opt4 from hemagglutinin__InfluenzaA__AEG65516

SEQ ID NO: 159306 - RNA, 1701 nt, Artificial Sequence; identical to SEQ ID NO: 159299
  derived and/or modified sequence opt4 from hemagglutinin__InfluenzaA__AEG65527

SEQ ID NO: 159307 - RNA, 1701 nt, Artificial Sequence; identical to SEQ ID NO: 159299
  derived and/or modified sequence opt4 from hemagglutinin__InfluenzaA__AEG65538

SEQ ID NO: 159308 - RNA, 1701 nt, Artificial Sequence
  derived and/or modified sequence opt4 from hemagglutinin__InfluenzaA__AEG65560
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugaucgccagcagcggcacccuggaguucaacaacgagagcuucaacuggaccggcgugacccagaacggcaccagcagcgccugcaagagaagaagcaacagcagcuucuucagcagacugaacuggcugacccaccugaaguucaaguaccccgcccugaacgugaccaugcccaacaacgaggaguucgacaagcuguacaucuggggcgugcaccaccccggcaccuacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugaagagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 159309 - RNA, 1701 nt, Artificial Sequence; identical to SEQ ID NO: 159308
  derived and/or modified sequence opt4 from hemagglutinin__InfluenzaA__AEG65571

SEQ ID NO: 159310 - RNA, 1701 nt, Artificial Sequence; identical to SEQ ID NO: 159308
  derived and/or modified sequence opt4 from hemagglutinin__InfluenzaA__AEG65582

SEQ ID NO: 159311 - RNA, 1701 nt, Artificial Sequence; identical to SEQ ID NO: 159308
  derived and/or modified sequence opt4 from hemagglutinin__InfluenzaA__AEG65593

SEQ ID NO: 159312 - RNA, 1701 nt, Artificial Sequence
  derived and/or modified sequence opt4 from hemagglutinin__InfluenzaA__AEG65604
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugaucgccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgaggaguucgacaagcuguacaucuggggcgugcaccaccccggcaccgacaacgaccagaucagccuguacgcccaggccagcggcaagaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 159313 - RNA, 1701 nt, Artificial Sequence
  derived and/or modified sequence opt4 from hemagglutinin__InfluenzaA__AEG65626
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaaagagcaacaacagcuucuucagcagacugaacuggcugacccaccugaaguucaaguaccccgcccugaacgugaccaugcccaacaacaagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacaugcugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 159314 - RNA, 1701 nt, Artificial Sequence
  derived and/or modified sequence opt4 from hemagglutinin__InfluenzaA__AEG65637
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaaagagcaacaacagcuucuucagcagacugaacuggcugacccaccugaaguucaaguaccccgcccugaacgugaccaugcccaacaacaagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacaugcugcugaucaacagcaccggcaaccugaucgcccccagaggcuacuucaagaucagaagcggcagaagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 159315 - RNA, 1701 nt, Artificial Sequence; identical to SEQ ID NO: 152551
  derived and/or modified sequence opt4 from hemagglutinin__InfluenzaA__AEG65648

SEQ ID NO: 159316 - RNA, 1701 nt, Artificial Sequence; identical to SEQ ID NO: 154315
  derived and/or modified sequence opt4 from hemagglutinin__InfluenzaA__AEG65659

SEQ ID NO: 159317 - RNA, 1701 nt, Artificial Sequence; identical to SEQ ID NO: 154315
  derived and/or modified sequence opt4 from hemagglutinin__InfluenzaA__AEG65670

SEQ ID NO: 159318 - RNA, 1701 nt, Artificial Sequence; identical to SEQ ID NO: 154315
  derived and/or modified sequence opt4 from hemagglutinin__InfluenzaA__AEG65681

SEQ ID NO: 159319 - RNA, 1701 nt, Artificial Sequence; identical to SEQ ID NO: 159290
  derived and/or modified sequence opt4 from hemagglutinin__InfluenzaA__AEG65692

SEQ ID NO: 159320 - RNA, 1701 nt, Artificial Sequence; identical to SEQ ID NO: 153150
  derived and/or modified sequence opt4 from hemagglutinin__InfluenzaA__AEG65703

SEQ ID NO: 159321 - RNA, 1701 nt, Artificial Sequence
  derived and/or modified sequence opt4 from hemagglutinin__InfluenzaA__AEG65747
augaagaccaucaucgcccugagcuacauccugugccugguguucgcccagaagcugcccggcaacgacaacagcaccgccacccugugccugggccaccacaccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 159322 - RNA, 1701 nt, Artificial Sequence
  derived and/or modified sequence opt4 from hemagglutinin__InfluenzaA__AEG65758
augaagaccaucaucgcccugagcuacauccugugccuggugagcgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 159323 - RNA, 1701 nt, Artificial Sequence; identical to SEQ ID NO: 152801
  derived and/or modified sequence opt4 from hemagglutinin__InfluenzaA__AEG65769

SEQ ID NO: 159324 - RNA, 1701 nt, Artificial Sequence
  derived and/or modified sequence opt4 from hemagglutinin__InfluenzaA__AEG65780
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacaagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccgccagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccgccggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 159325 - RNA, 1701 nt, Artificial Sequence
  derived and/or modified sequence opt4 from hemagglutinin__InfluenzaA__AEG65813
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccgccggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaccgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 159326 - RNA, 1701 nt, Artificial Sequence
  derived and/or modified sequence opt4 from hemagglutinin__InfluenzaA__AEG79801
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagacagagagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159327 - RNA, 1701 nt, Artificial Sequence
  derived and/or modified sequence opt4 from hemagglutinin__InfluenzaA__AEG79807
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaaggagaacagcuaccccaagcugagcaagagcuacaucaacgacaagggcaaggaggugcuggugcuguggggcauccaccaccccagcaccaccgccgaccagcagagcaucuaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159328 - RNA, 1701 nt, Artificial Sequence
  derived and/or modified sequence opt4 from hemagglutinin__InfluenzaA__AEG79835
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagcaucuaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159329 - RNA, 1701 nt, Artificial Sequence
  derived and/or modified sequence opt4 from hemagglutinin__InfluenzaA__AEH59363
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccaggccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcaaguacagcaagaaguucaagcccgagaucgccgugagacccaaggugagagaccaggagggcagaaugaacuacuacuggacccugguggagcccggcgacaagaucaccuucgaggccaccggcaaccugcuggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgcccagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159330 - RNA, 1701 nt, Artificial Sequence
  derived and/or modified sequence opt4 from hemagglutinin__InfluenzaA__AEH59367
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacugggcccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159331 - RNA, 1701 nt, Artificial Sequence
  derived and/or modified sequence opt4 from hemagglutinin__InfluenzaA__AEH59369
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaaggccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159332 - RNA, 1701 nt, Artificial Sequence; identical to SEQ ID NO: 159329
  derived and/or modified sequence opt4 from hemagglutinin__InfluenzaA__AEH59371

SEQ ID NO: 159333 - RNA, 1701 nt, Artificial Sequence
  derived and/or modified sequence opt4 from hemagglutinin__InfluenzaA__AEH59373
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagagagguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuacagacaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagagaagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159334 - RNA, 1701 nt, Artificial Sequence; identical to SEQ ID NO: 159329
  derived and/or modified sequence opt4 from hemagglutinin__InfluenzaA__AEH59375

SEQ ID NO: 159335 - RNA, 1701 nt, Artificial Sequence
  derived and/or modified sequence opt4 from hemagglutinin__InfluenzaA__AEH59379
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaccggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159336 - RNA, 1701 nt, Artificial Sequence; identical to SEQ ID NO: 159329
  derived and/or modified sequence opt4 from hemagglutinin__InfluenzaA__AEH59381

SEQ ID NO: 159337 - RNA, 1701 nt, Artificial Sequence
  derived and/or modified sequence opt4 from hemagglutinin__InfluenzaA__AEH59383
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaucagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159338 - RNA, 1701 nt, Artificial Sequence
  derived and/or modified sequence opt4 from hemagglutinin__InfluenzaA__AEH59385
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacaucuucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159339 - RNA, 1701 nt, Artificial Sequence; identical to SEQ ID NO: 159329
  derived and/or modified sequence opt4 from hemagglutinin__InfluenzaA__AEH59387

SEQ ID NO: 159340 - RNA, 1701 nt, Artificial Sequence
  derived and/or modified sequence opt4 from hemagglutinin__InfluenzaA__AEH59393
augaaggccauccugguggugauccuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159341 - RNA, 1701 nt, Artificial Sequence
  derived and/or modified sequence opt4 from hemagglutinin__InfluenzaA__AEH59397
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccagccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcaaguacagcaagaaguucaagcccgagaucgccgugagacccaaggugagagaccaggagggcagaaugaacuacuacuggacccugguggagcccggcgacaagaucaccuucgaggccaccggcaaccugcuggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucgagaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159342 - RNA, 1701 nt, Artificial Sequence
  derived and/or modified sequence opt4 from hemagglutinin__InfluenzaA__AEH59399
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggaccaucguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159343 - RNA, 1701 nt, Artificial Sequence
  derived and/or modified sequence opt4 from hemagglutinin__InfluenzaA__AEH59403
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggcccccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159344 - RNA, 1701 nt, Artificial Sequence
  derived and/or modified sequence opt4 from hemagglutinin__InfluenzaA__AEH59407
augaaggccauccugguggugaugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159345 - RNA, 1701 nt, Artificial Sequence; identical to SEQ ID NO: 159344
  derived and/or modified sequence opt4 from hemagglutinin__InfluenzaA__AEH59409

SEQ ID NO: 159346 - RNA, 1701 nt, Artificial Sequence
  derived and/or modified sequence opt4 from hemagglutinin__InfluenzaA__AEH59411
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggacagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159347 - RNA, 1701 nt, Artificial Sequence
  derived and/or modified sequence opt4 from hemagglutinin__InfluenzaA__AEH59413
augaaggccauccugguggugcugcuguacaccuucgccaucgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcaaguacagcaagaaguucaagcccgagaucgccgugagacccaaggugagagaccaggagggcagaaugaacuacuacuggacccugguggagcccggcgacaagaucaccuucgaggccaccggcaaccugcuggugcccagauacgccuucgccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159348 - RNA, 1701 nt, Artificial Sequence
  derived and/or modified sequence opt4 from hemagglutinin__InfluenzaA__AEH59585
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgaccccaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccguggugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159349 - RNA, 1701 nt, Artificial Sequence
  derived and/or modified sequence opt4 from hemagglutinin__InfluenzaA__AEH59587
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgagagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccuucauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccguggugggcaaggaguucaacccccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159350 - RNA, 1701 nt, Artificial Sequence; identical to SEQ ID NO: 156353
  derived and/or modified sequence opt4 from hemagglutinin__InfluenzaA__AEH59589

SEQ ID NO: 159351 - RNA, 1701 nt, Artificial Sequence
  derived and/or modified sequence opt4 from hemagglutinin__InfluenzaA__AEH59591
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccguggugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159352 - RNA, 1701 nt, Artificial Sequence
  derived and/or modified sequence opt4 from hemagglutinin__InfluenzaA__AEH59593
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgagagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagcaucuaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159353 - RNA, 1701 nt, Artificial Sequence; identical to SEQ ID NO: 155987
  derived and/or modified sequence opt4 from hemagglutinin__InfluenzaA__AEH59595

SEQ ID NO: 159354 - RNA, 1701 nt, Artificial Sequence; identical to SEQ ID NO: 156353
  derived and/or modified sequence opt4 from hemagglutinin__InfluenzaA__AEH59597

SEQ ID NO: 159355 - RNA, 1701 nt, Artificial Sequence; identical to SEQ ID NO: 159348
  derived and/or modified sequence opt4 from hemagglutinin__InfluenzaA__AEH59599

SEQ ID NO: 159356 - RNA, 1701 nt, Artificial Sequence
  derived and/or modified sequence opt4 from hemagglutinin__InfluenzaA__AEH59601
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaacugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccguggugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159357 - RNA, 1701 nt, Artificial Sequence; identical to SEQ ID NO: 155987
  derived and/or modified sequence opt4 from hemagglutinin__InfluenzaA__AEH59604

SEQ ID NO: 159358 - RNA, 1701 nt, Artificial Sequence; identical to SEQ ID NO: 155987
  derived and/or modified sequence opt4 from hemagglutinin__InfluenzaA__AEH59614

SEQ ID NO: 159359 - RNA, 1701 nt, Artificial Sequence
  derived and/or modified sequence opt4 from hemagglutinin__InfluenzaA__AEH59624
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgaccccaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagcuucuaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159360 - RNA, 1698 nt, Artificial Sequence
  derived and/or modified sequence opt4 from hemagglutinin__InfluenzaA__AEH77259
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagauguuccccaaggagagcagcuggcccaaccacaccgugaccggcgugagcgccagcugcagccacaacggcgagagcagcuucuacagaaaccugcuguggcugaccgagaagaacggccuguaccccaaccugagcaagagcuacgccaacaacaaggagaaggaggugcuggugcuguggggcgugcaccacccccccagcaucagcgaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagaaccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccugguguuccuggugagccugggcgccaucagcuucuggaugugcagcaacggcagccugcagugcagaaucugcaucuga

SEQ ID NO: 159361 - RNA, 1701 nt, Artificial Sequence; identical to SEQ ID NO: 155176
  derived and/or modified sequence opt4 from hemagglutinin__InfluenzaA__AEH77270

SEQ ID NO: 159362 - RNA, 1701 nt, Artificial Sequence; identical to SEQ ID NO: 152552
  derived and/or modified sequence opt4 from hemagglutinin__InfluenzaA__AEH77279

SEQ ID NO: 159363 - RNA, 1701 nt, Artificial Sequence; identical to SEQ ID NO: 156291
  derived and/or modified sequence opt4 from hemagglutinin__InfluenzaA__AEI29215

SEQ ID NO: 159364 - RNA, 1701 nt, Artificial Sequence; identical to SEQ ID NO: 155189
  derived and/or modified sequence opt4 from hemagglutinin__InfluenzaA__AEI29225

SEQ ID NO: 159365 - RNA, 1701 nt, Artificial Sequence
  derived and/or modified sequence opt4 from hemagglutinin__InfluenzaA__AEI29591
augaagaccaucaucgcccugagcuacaucuucugccugguguucgcccaggaccugcccggcaacgacaacagcaccgccacccugugccugggccaccacgccgugcccaacggcacccuggugaagaccaucaccaacgaccagaucgaggugaccaacgccaccgagcuggugcagagcagcagcaccggcaagaucugcgacaacccccacagaauccuggacggcaucaacugcacccugaucgacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucaucaacgagggcuucaacuggaccggcgugacccagaacggcggcagcagcgccugcaagagaggccccgacaacggcuucuucagcagacugaacuggcuguacaagagcggcagcaccuaccccgugcagaacgugaccaugcccaacaacgacaacagcgacaagcuguacaucuggggcgugcaccaccccagcaccgacaaggagcagaccaaccuguacgugcaggccagcggcaaggugaccgugagcaccaagagaagccagcagaccgugauccccaacgugggcagcagacccugggugagaggccugagcagcagagugagcaucuacuggaccaucgugaagcccggcgacauccuggugaucaacagcaacggcaaccugaucgcccccagaggcuacuacaagaugagaaccggcaagagcagcaucaugagaagcgacgcccccaucggcaccugcagcagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggcaucuucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 159366 - RNA, 1701 nt, Artificial Sequence; identical to SEQ ID NO: 152552
  derived and/or modified sequence opt4 from hemagglutinin__InfluenzaA__AEI54347

SEQ ID NO: 159367 - RNA, 1701 nt, Artificial Sequence; identical to SEQ ID NO: 152638
  derived and/or modified sequence opt4 from hemagglutinin__InfluenzaA__AEI54358

SEQ ID NO: 159368 - RNA, 1701 nt, Artificial Sequence; identical to SEQ ID NO: 153153
  derived and/or modified sequence opt4 from hemagglutinin__InfluenzaA__AEI54369

SEQ ID NO: 159369 - RNA, 1701 nt, Artificial Sequence; identical to SEQ ID NO: 153036
  derived and/or modified sequence opt4 from hemagglutinin__InfluenzaA__AEI54380

SEQ ID NO: 159370 - RNA, 1701 nt, Artificial Sequence; identical to SEQ ID NO: 159299
  derived and/or modified sequence opt4 from hemagglutinin__InfluenzaA__AEI54391

SEQ ID NO: 159371 - RNA, 1701 nt, Artificial Sequence
  derived and/or modified sequence opt4 from hemagglutinin__InfluenzaA__AEI54402
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcuacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 159372 - RNA, 1701 nt, Artificial Sequence; identical to SEQ ID NO: 154448
  derived and/or modified sequence opt4 from hemagglutinin__InfluenzaA__AEI54413

SEQ ID NO: 159373 - RNA, 1701 nt, Artificial Sequence; identical to SEQ ID NO: 152801
  derived and/or modified sequence opt4 from hemagglutinin__InfluenzaA__AEI54424

SEQ ID NO: 159374 - RNA, 1701 nt, Artificial Sequence
  derived and/or modified sequence opt4 from hemagglutinin__InfluenzaA__AEI54446
augaagaccaucaucgcccugagcuacauccugugccugguguucgcccagaagcugcccgagaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccgccggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 159375 - RNA, 1701 nt, Artificial Sequence
  derived and/or modified sequence opt4 from hemagglutinin__InfluenzaA__AEI54457
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccgccggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 159376 - RNA, 1701 nt, Artificial Sequence; identical to SEQ ID NO: 158053
  derived and/or modified sequence opt4 from hemagglutinin__InfluenzaA__AEI54468

SEQ ID NO: 159377 - RNA, 1701 nt, Artificial Sequence; identical to SEQ ID NO: 158053
  derived and/or modified sequence opt4 from hemagglutinin__InfluenzaA__AEI54479

SEQ ID NO: 159378 - RNA, 1701 nt, Artificial Sequence; identical to SEQ ID NO: 159375
  derived and/or modified sequence opt4 from hemagglutinin__InfluenzaA__AEI54490

SEQ ID NO: 159379 - RNA, 1701 nt, Artificial Sequence; identical to SEQ ID NO: 159374
  derived and/or modified sequence opt4 from hemagglutinin__InfluenzaA__AEI54501

SEQ ID NO: 159380 - RNA, 1701 nt, Artificial Sequence
  derived and/or modified sequence opt4 from hemagglutinin__InfluenzaA__AEI59979
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaucagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 159381 - RNA, 1698 nt, Artificial Sequence; identical to SEQ ID NO: 158477
  derived and/or modified sequence opt4 from hemagglutinin__InfluenzaA__AEI59990

SEQ ID NO: 159382 - RNA, 1698 nt, Artificial Sequence; identical to SEQ ID NO: 158479
  derived and/or modified sequence opt4 from hemagglutinin__InfluenzaA__AEI60001

SEQ ID NO: 159383 - RNA, 1701 nt, Artificial Sequence
  derived and/or modified sequence opt4 from hemagglutinin__InfluenzaA__AEI60012
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagcagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcaagauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 159384 - RNA, 1701 nt, Artificial Sequence; identical to SEQ ID NO: 154954
  derived and/or modified sequence opt4 from hemagglutinin__InfluenzaA__AEI60023

SEQ ID NO: 159385 - RNA, 1701 nt, Artificial Sequence
  derived and/or modified sequence opt4 from hemagglutinin__InfluenzaA__AEI60034
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 159386 - RNA, 1701 nt, Artificial Sequence
  derived and/or modified sequence opt4 from hemagglutinin__InfluenzaA__AEI60045
augaagaccaucaucgcccugagcuacauccugugccugguguucgcccagaagcugcccggcaacgacaacagcaccgccacccugugccugggccaccacgccgugcccaacggcaccaucgugaagaccaucaugaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgccauccccaacaucggcuacagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 159387 - RNA, 1701 nt, Artificial Sequence
  derived and/or modified sequence opt4 from hemagglutinin__InfluenzaA__AEI60086
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159388 - RNA, 1701 nt, Artificial Sequence
  derived and/or modified sequence opt4 from hemagglutinin__InfluenzaA__AEI60109
augaagaccaccaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagaacagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacaacgugcccgacuacgugagccugagaagccugguggccagcagcggcacccuggaguucaacaacgagagcuucaacuggaccggcguggcccaggacggcagcagcuacgccugcaagagaagaagcaacaagagcuucuucagcagacugaacuggcugcaccagcugaacuacaaguaccccgcccugaacgugaccaugcccaacaacgagaacuucgacaagcuguacaucuggggcgugcaccaccccggcaccgacagcgaccagaucagccuguacgcccaggccagcggcagagugaccgugagcaccaagagaagccagcagaccgugauccccaacaucggcuacagacccugggugagaggcgugagcagcaucaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggccccugccccagauacgugaagcagaacacccugaagcuggccaccggcaugagaaacgugcccgagaagcagaccagaggcaucuucggcgccaucgccggcuucaucgagaacggcugggagggcaugaaggacggcugguacggcuucagacaccagaacagcgagggcaccggccaggccgccgacaucaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacaccugcaucggcagcaucagaaacggcaccuacgaccacgacguguacagagacgaggcccugaacaacagauuccacaucaagggcguggagcugaagagcggcuacaaggacuggauccuguggaucagcuucgccaccagcugcuuccugcugugcaucgugcugcugggcuucaucaugugggccugccagaagggcaacaucagaugcaacaucugcaucuga

SEQ ID NO: 159389 - RNA, 1701 nt, Artificial Sequence
  derived and/or modified sequence opt4 from hemagglutinin__InfluenzaA__AEI86734
augaaggccauccugguggugcugcuguacaccuucgccaccgccaacgccgacacccugugcgugggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcaacagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacagaaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159390 - RNA, 1701 nt, Artificial Sequence
  derived and/or modified sequence opt4 from hemagglutinin__InfluenzaA__AEI86764
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccgaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159391 - RNA, 1701 nt, Artificial Sequence; identical to SEQ ID NO: 159390
  derived and/or modified sequence opt4 from hemagglutinin__InfluenzaA__AEI86774

SEQ ID NO: 159392 - RNA, 1701 nt, Artificial Sequence
  derived and/or modified sequence opt4 from hemagglutinin__InfluenzaA__AEI86784
augaaggugauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucaagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159393 - RNA, 1701 nt, Artificial Sequence
  derived and/or modified sequence opt4 from hemagglutinin__InfluenzaA__AEI86794
augaagaccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcaacuucaucgacuacgaggagcugagagagcagcugagcagcgugagcagcuucgagagauucgagaucuuccccaagaccagcagcuggcccgaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcaaguacagcaagaaguucaagcccgagaucgccaucagacccaaggugagagaccaggagggcagaaugaacuacuacuggacccugguggagcccggcgacaagaucaccuucgaggccaccggcaaccugguggcccccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159394 - RNA, 1701 nt, Artificial Sequence
  derived and/or modified sequence opt4 from hemagglutinin__InfluenzaA__AEI86804
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccgaccacgacagcaacaagggcgugaccgccgccugcccccacgccggcgccaagagcuucuacaagaaccugauguggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcgccguggccagcagccuggugcugguggugagccugggcgccaucagcuucuggaugugcagcaacggcagccugcagugcagaaucugcaucuga

SEQ ID NO: 159395 - RNA, 1701 nt, Artificial Sequence; identical to SEQ ID NO: 159390
  derived and/or modified sequence opt4 from hemagglutinin__InfluenzaA__AEI86814

SEQ ID NO: 159396 - RNA, 1701 nt, Artificial Sequence
  derived and/or modified sequence opt4 from hemagglutinin__InfluenzaA__AEI86824
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccgaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccaggacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159397 - RNA, 1701 nt, Artificial Sequence
  derived and/or modified sequence opt4 from hemagglutinin__InfluenzaA__AEI86834
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcaacuucaucgacuacgaggagcugagagagcagcugagcagcgugagcagcuucgagagauucgagaucuuccccaagaccagcagcuggcccgaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcagaaaguucaagcccgagaucgccaucagacccaaggugagagaccaggagggcagaaugaacuacuacuggacccugguggagcccggcgacaagaucaccuucgaggccaccggcaaccugguggcccccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159398 - RNA, 1701 nt, Artificial Sequence; identical to SEQ ID NO: 158104
  derived and/or modified sequence opt4 from hemagglutinin__InfluenzaA__AEI86854

SEQ ID NO: 159399 - RNA, 1701 nt, Artificial Sequence
  derived and/or modified sequence opt4 from hemagglutinin__InfluenzaA__AEI86864
augaaggccauccugguggcccugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159400 - RNA, 1701 nt, Artificial Sequence; identical to SEQ ID NO: 159390
  derived and/or modified sequence opt4 from hemagglutinin__InfluenzaA__AEI86874

SEQ ID NO: 159401 - RNA, 1701 nt, Artificial Sequence
  derived and/or modified sequence opt4 from hemagglutinin__InfluenzaA__AEI86894
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcaacuucaucgacuacgaggagcugagagagcagcugagcagcgugagcagcuucgagagauucgagaucuuccccaagaccagcagcuggcccgaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggcccccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159402 - RNA, 1701 nt, Artificial Sequence
  derived and/or modified sequence opt4 from hemagglutinin__InfluenzaA__AEI86904
augaaggccauccugguggugcugcuguacaccuucaccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159403 - RNA, 1701 nt, Artificial Sequence
  derived and/or modified sequence opt4 from hemagglutinin__InfluenzaA__AEI86914
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccagacugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159404 - RNA, 1701 nt, Artificial Sequence
  derived and/or modified sequence opt4 from hemagglutinin__InfluenzaA__AEI86924
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcguguucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcugaucaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccgugagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159405 - RNA, 1701 nt, Artificial Sequence; identical to SEQ ID NO: 159390
  derived and/or modified sequence opt4 from hemagglutinin__InfluenzaA__AEI86934

SEQ ID NO: 159406 - RNA, 1701 nt, Artificial Sequence; identical to SEQ ID NO: 158104
  derived and/or modified sequence opt4 from hemagglutinin__InfluenzaA__AEI86944

SEQ ID NO: 159407 - RNA, 1701 nt, Artificial Sequence
  derived and/or modified sequence opt4 from hemagglutinin__InfluenzaA__AEI86964
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcguguucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccgugagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaugugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159408 - RNA, 1701 nt, Artificial Sequence; identical to SEQ ID NO: 158346
  derived and/or modified sequence opt4 from hemagglutinin__InfluenzaA__AEI86974

SEQ ID NO: 159409 - RNA, 1701 nt, Artificial Sequence; identical to SEQ ID NO: 158104
  derived and/or modified sequence opt4 from hemagglutinin__InfluenzaA__AEI86984

SEQ ID NO: 159410 - RNA, 1701 nt, Artificial Sequence; identical to SEQ ID NO: 158104
  derived and/or modified sequence opt4 from hemagglutinin__InfluenzaA__AEI86994

SEQ ID NO: 159411 - RNA, 1701 nt, Artificial Sequence
  derived and/or modified sequence opt4 from hemagglutinin__InfluenzaA__AEI87004
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugaagggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcaacuucaucgacuacgaggagcugagagagcagcugagcagcgugagcagcuucgagagauucgagaucuuccccaagaccagcagcuggcccgaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagggccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggcccccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159412 - RNA, 1701 nt, Artificial Sequence
  derived and/or modified sequence opt4 from hemagglutinin__InfluenzaA__AEI87014
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcggcgaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159413 - RNA, 1701 nt, Artificial Sequence
  derived and/or modified sequence opt4 from hemagglutinin__InfluenzaA__AEI87034
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccgaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccaucggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159414 - RNA, 1701 nt, Artificial Sequence; identical to SEQ ID NO: 158104
  derived and/or modified sequence opt4 from hemagglutinin__InfluenzaA__AEI87044

SEQ ID NO: 159415 - RNA, 1701 nt, Artificial Sequence; identical to SEQ ID NO: 156353
  derived and/or modified sequence opt4 from hemagglutinin__InfluenzaA__AEI87054

SEQ ID NO: 159416 - RNA, 1701 nt, Artificial Sequence
  derived and/or modified sequence opt4 from hemagglutinin__InfluenzaA__AEI87064
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccgccgccagcagccuggugcugguggugagccugggcgccaucagcuucuggaugugcagcaacggcagccugcagugcagaaucugcaucuga

SEQ ID NO: 159417 - RNA, 1701 nt, Artificial Sequence
  derived and/or modified sequence opt4 from hemagglutinin__InfluenzaA__AEI87074
augaaggccacccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159418 - RNA, 1701 nt, Artificial Sequence
  derived and/or modified sequence opt4 from hemagglutinin__InfluenzaA__AEI87094
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccgaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacaccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcaucaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159419 - RNA, 1701 nt, Artificial Sequence; identical to SEQ ID NO: 159418
  derived and/or modified sequence opt4 from hemagglutinin__InfluenzaA__AEI87104

SEQ ID NO: 159420 - RNA, 1698 nt, Artificial Sequence; identical to SEQ ID NO: 156146
  derived and/or modified sequence opt4 from hemagglutinin__InfluenzaA__AEI91963

SEQ ID NO: 159421 - RNA, 1701 nt, Artificial Sequence; identical to SEQ ID NO: 156353
  derived and/or modified sequence opt4 from hemagglutinin__InfluenzaA__AEI91977

SEQ ID NO: 159422 - RNA, 1701 nt, Artificial Sequence; identical to SEQ ID NO: 157877
  derived and/or modified sequence opt4 from hemagglutinin__InfluenzaA__AEI91978

SEQ ID NO: 159423 - RNA, 1701 nt, Artificial Sequence; identical to SEQ ID NO: 156819
  derived and/or modified sequence opt4 from hemagglutinin__InfluenzaA__AEI91998

SEQ ID NO: 159424 - RNA, 1701 nt, Artificial Sequence
  derived and/or modified sequence opt4 from hemagglutinin__InfluenzaA__AEI91999
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccugaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 159425 - RNA, 1698 nt, Artificial Sequence
  derived and/or modified sequence opt4 from hemagglutinin__InfluenzaA__AEI92018
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucgccgaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 159426 - RNA, 1701 nt, Artificial Sequence; identical to SEQ ID NO: 159401
  derived and/or modified sequence opt4 from hemagglutinin__InfluenzaA__AEJ10400

SEQ ID NO: 159427 - RNA, 1701 nt, Artificial Sequence
  derived and/or modified sequence opt4 from hemagglutinin__InfluenzaA__AEJ10410
augaagaccauccugguggugcugcuguacaccuucgccaccgccaacgccgacacccugugcaucggcuaccacgccaacaacagcaccgacaccaucgacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcaacuucaucgacuacgaggagcugagagagcagcugagcagcgugagcagcuucgagagauucgagaucuuccccaagaccagcagcuggagcgaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggcccccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159428 - RNA, 1701 nt, Artificial Sequence
  derived and/or modified sequence opt4 from hemagglutinin__InfluenzaA__AEJ10420
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacagacacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccgaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159429 - RNA, 1701 nt, Artificial Sequence
  derived and/or modified sequence opt4 from hemagglutinin__InfluenzaA__AEJ10430
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccaccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccacccccccaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159430 - RNA, 1701 nt, Artificial Sequence
  derived and/or modified sequence opt4 from hemagglutinin__InfluenzaA__AEJ10440
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagauccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159431 - RNA, 1701 nt, Artificial Sequence; identical to SEQ ID NO: 159344
  derived and/or modified sequence opt4 from hemagglutinin__InfluenzaA__AEJ10450

SEQ ID NO: 159432 - RNA, 1701 nt, Artificial Sequence
  derived and/or modified sequence opt4 from hemagglutinin__InfluenzaA__AEJ10480
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccaggccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagagcgccgacgccuacguguucgugggcaccagcaaguacagcaagaaguucaagcccgagaucgccgugagacccaaggugagagaccaggagggcagaaugaacuacuacuggacccugguggagcccggcgacaagaucaccuucgaggccaccggcaaccugcuggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgcccagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159433 - RNA, 1701 nt, Artificial Sequence
  derived and/or modified sequence opt4 from hemagglutinin__InfluenzaA__AEJ10490
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccaccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccacccccccaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcagaugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacggcaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccaugaucuaccagauccuggccaucuacagcaccguggccagcagccuggugcugaucgugagccugggcgccaucagcuucuggaugugcagcaacggcagccugcagugcagaaucugcaucuga

SEQ ID NO: 159434 - RNA, 1701 nt, Artificial Sequence
  derived and/or modified sequence opt4 from hemagglutinin__InfluenzaA__AEJ10500
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggagggcaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugaacaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159435 - RNA, 1701 nt, Artificial Sequence; identical to SEQ ID NO: 159387
  derived and/or modified sequence opt4 from hemagglutinin__InfluenzaA__AEJ10510

SEQ ID NO: 159436 - RNA, 1701 nt, Artificial Sequence
  derived and/or modified sequence opt4 from hemagglutinin__InfluenzaA__AEJ10520
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaacuacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugcagcaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159437 - RNA, 1701 nt, Artificial Sequence; identical to SEQ ID NO: 155189
  derived and/or modified sequence opt4 from hemagglutinin__InfluenzaA__AEJ10530

SEQ ID NO: 159438 - RNA, 1701 nt, Artificial Sequence; identical to SEQ ID NO: 155189
  derived and/or modified sequence opt4 from hemagglutinin__InfluenzaA__AEJ10540

SEQ ID NO: 159439 - RNA, 1701 nt, Artificial Sequence; identical to SEQ ID NO: 155189
  derived and/or modified sequence opt4 from hemagglutinin__InfluenzaA__AEJ10550

SEQ ID NO: 159440 - RNA, 1701 nt, Artificial Sequence
  derived and/or modified sequence opt4 from hemagglutinin__InfluenzaA__AEJ10570
augaaggccauccugguggugcugcuguacacccuggccaccgccaacgccgacacccugugcaucggcuaccacgccaacaacagcaccgacaccguggacaccgugcuggagaagaacgugaccgugacccacagcgugaaccugcuggaggacaagcacgacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacgccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159441 - RNA, 1701 nt, Artificial Sequence; identical to SEQ ID NO: 159440
  derived and/or modified sequence opt4 from hemagglutinin__InfluenzaA__AEJ10580

SEQ ID NO: 159442 - RNA, 1701 nt, Artificial Sequence
  derived and/or modified sequence opt4 from hemagglutinin__InfluenzaA__AEJ36302
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcuacaacggcaccugcuaccccggcgacuucaucgacuacgaggagcugagagagcagcugagcagcgugagcagcuucgagagauucgagaucuuccccaagaccagcagcuggcccaaccacgaccccaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagacuguaccagaacgccgacgccuacgccuucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgcccacgacugcaacaccaccugccagacccccaagggcgccaucaacaccagccugcccuuccagaacgugcaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccuucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaccggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159443 - RNA, 1701 nt, Artificial Sequence
  derived and/or modified sequence opt4 from hemagglutinin__InfluenzaA__AEJ36312
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccgaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacauccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159444 - RNA, 1701 nt, Artificial Sequence
  derived and/or modified sequence opt4 from hemagglutinin__InfluenzaA__AEJ37853
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggaggccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaugugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159445 - RNA, 1701 nt, Artificial Sequence
  derived and/or modified sequence opt4 from hemagglutinin__InfluenzaA__AEJ37863
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaagcugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159446 - RNA, 1701 nt, Artificial Sequence; identical to SEQ ID NO: 156353
  derived and/or modified sequence opt4 from hemagglutinin__InfluenzaA__AEJ37873

SEQ ID NO: 159447 - RNA, 1701 nt, Artificial Sequence; identical to SEQ ID NO: 159401
  derived and/or modified sequence opt4 from hemagglutinin__InfluenzaA__AEJ37883

SEQ ID NO: 159448 - RNA, 1701 nt, Artificial Sequence
  derived and/or modified sequence opt4 from hemagglutinin__InfluenzaA__AEJ37893
augaaggccauccugguggugcugcuguacaccuucgccaccaccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcaacuucaucgacuacgaggagcugagagagcagcugagcagcgugagcagcuucgagagauucgagaucuuccccaagaccagcagcuggcccgaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggcccccagauacgccuucgccauggagagaaacgccggcagcggcaucaucaucagcgacaagcccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159449 - RNA, 1701 nt, Artificial Sequence; identical to SEQ ID NO: 159401
  derived and/or modified sequence opt4 from hemagglutinin__InfluenzaA__AEJ37903

SEQ ID NO: 159450 - RNA, 1701 nt, Artificial Sequence
  derived and/or modified sequence opt4 from hemagglutinin__InfluenzaA__AEJ37923
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcaacuucaucgacuacgaggagcugagagagcagcugagcagcgugagcagcuucgagagauucgagaucuuccccaagaccagcagcuggcccgaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggcccccagauacgccuucgccaucgagagaauggccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159451 - RNA, 1701 nt, Artificial Sequence
  derived and/or modified sequence opt4 from hemagglutinin__InfluenzaA__AEJ37943
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuaccacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159452 - RNA, 1701 nt, Artificial Sequence; identical to SEQ ID NO: 159401
  derived and/or modified sequence opt4 from hemagglutinin__InfluenzaA__AEJ37953

SEQ ID NO: 159453 - RNA, 1701 nt, Artificial Sequence
  derived and/or modified sequence opt4 from hemagglutinin__InfluenzaA__AEJ37963
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcaacuucaucgacuacgaggagcugagagagcagcugagcagcgugagcagcuucgagagauucgagaucuuccccaagaccagcagcuggcccgaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggcccccagauacgccuucgccauggagagaaacgccggcagcggcaucaucaucagcgacacccccgugcacgacugcaacaccaccugccagacccccaagggcgccaccaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159454 - RNA, 1701 nt, Artificial Sequence; identical to SEQ ID NO: 156353
  derived and/or modified sequence opt4 from hemagglutinin__InfluenzaA__AEJ37973

SEQ ID NO: 159455 - RNA, 1701 nt, Artificial Sequence; identical to SEQ ID NO: 159401
  derived and/or modified sequence opt4 from hemagglutinin__InfluenzaA__AEJ37983

SEQ ID NO: 159456 - RNA, 1701 nt, Artificial Sequence; identical to SEQ ID NO: 158053
  derived and/or modified sequence opt4 from hemagglutinin__InfluenzaA__AEK21369

SEQ ID NO: 159457 - RNA, 1698 nt, Artificial Sequence; identical to SEQ ID NO: 156136
  derived and/or modified sequence opt4 from hemagglutinin__InfluenzaA__AEK21380

SEQ ID NO: 159458 - RNA, 1701 nt, Artificial Sequence
  derived and/or modified sequence opt4 from hemagglutinin__InfluenzaA__AEK21396
augaaggccauccugguggugcugcuguacaccuucgccaccgccaacgccgacacccugugcaucggcuaccacgccaacaacagcaccgacaccguggacaccgugcuggagaagaacgugaccgugacccacagcguggaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcaaguacagcaagaaguucaagcccgagaucgccaucagacccaaggugagagaccaggagggcagaaugaacuacuacuggacccugguggagcccggcgacaagaucaccuucgaggccaccggcaaccugcuggugcccagauacgccuucgagauggagagaaagagcggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159459 - RNA, 1701 nt, Artificial Sequence
  derived and/or modified sequence opt4 from hemagglutinin__InfluenzaA__AEK21406
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcaugagcagcuucgagagauucgagaucuuccccaagaccagcagcuggcccgaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159460 - RNA, 1701 nt, Artificial Sequence
  derived and/or modified sequence opt4 from hemagglutinin__InfluenzaA__AEK21416
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcguguucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccgugagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159461 - RNA, 1701 nt, Artificial Sequence
  derived and/or modified sequence opt4 from hemagglutinin__InfluenzaA__AEK21426
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcaacuucaucgacuacgaggagcugagagagcagcugagcagcgugagcagcuucgagagauucgagaucuuccccaagaccagcagcuggcccgaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggcccccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugagaagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159462 - RNA, 1701 nt, Artificial Sequence; identical to SEQ ID NO: 156353
  derived and/or modified sequence opt4 from hemagglutinin__InfluenzaA__AEK21436

SEQ ID NO: 159463 - RNA, 1701 nt, Artificial Sequence
  derived and/or modified sequence opt4 from hemagglutinin__InfluenzaA__AEK21456
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagaacgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159464 - RNA, 1701 nt, Artificial Sequence; identical to SEQ ID NO: 159401
  derived and/or modified sequence opt4 from hemagglutinin__InfluenzaA__AEK21466

SEQ ID NO: 159465 - RNA, 1701 nt, Artificial Sequence; identical to SEQ ID NO: 159401
  derived and/or modified sequence opt4 from hemagglutinin__InfluenzaA__AEK21476

SEQ ID NO: 159466 - RNA, 1701 nt, Artificial Sequence; identical to SEQ ID NO: 156353
  derived and/or modified sequence opt4 from hemagglutinin__InfluenzaA__AEK21486

SEQ ID NO: 159467 - RNA, 1701 nt, Artificial Sequence
  derived and/or modified sequence opt4 from hemagglutinin__InfluenzaA__AEK28774
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgccauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccauccaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 159468 - RNA, 1701 nt, Artificial Sequence
  derived and/or modified sequence opt4 from hemagglutinin__InfluenzaA__AEK28785
augaagaccaucaucgcccugagcuacauccugugccugguguucgcccagaaccugcccggcaacgacaacagcgccgccacccugugccugggccaccacgccgugcccaacggcaccaucgugaagaccaucaccaacgaccagguggaggugaccaacgccaccgagcuggugcagaacagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccauccaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 159469 - RNA, 1701 nt, Artificial Sequence
  derived and/or modified sequence opt4 from hemagglutinin__InfluenzaA__AEK28796
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacaagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccaggacggcaccagcagcgccugcaucagaggcagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgccauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccauccaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 159470 - RNA, 1701 nt, Artificial Sequence
  derived and/or modified sequence opt4 from hemagglutinin__InfluenzaA__AEK28807
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacggcaacugcuaccccuacgacgugcccgacuacgccagccugagaagccugguggccagcagcggcacccuggaguucaacaacgagagcuucaacuggaccggcgugacccagaacggcaccagcagcgccugcaucagaaagagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccauccaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 159471 - RNA, 1701 nt, Artificial Sequence
  derived and/or modified sequence opt4 from hemagglutinin__InfluenzaA__AEK28818
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacaacaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccauccaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 159472 - RNA, 1701 nt, Artificial Sequence
  derived and/or modified sequence opt4 from hemagglutinin__InfluenzaA__AEK28828
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccauccaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggugugccagaagggcaacaucagaugcaacaucugcaucuga

SEQ ID NO: 159473 - RNA, 1701 nt, Artificial Sequence; identical to SEQ ID NO: 154954
  derived and/or modified sequence opt4 from hemagglutinin__InfluenzaA__AEK28839

SEQ ID NO: 159474 - RNA, 1701 nt, Artificial Sequence
  derived and/or modified sequence opt4 from hemagglutinin__InfluenzaA__AEK28850
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacugagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 159475 - RNA, 1701 nt, Artificial Sequence
  derived and/or modified sequence opt4 from hemagglutinin__InfluenzaA__AEK28861
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugaaggagaacgccgaggacaugggcaacggcugcuucaagaucuaccacaagugcgacaacgccugcaucggcagcaucagaaacggcaccuacgaccacgacguguacagagacgaggcccugaacaacagauuccacaucaagggcguggagcugaagagcggcuacaaggacuggauccuguggaucagcuucgccaccagcugcuuccugcugugcguggcccugcugggcuucaucaugugggccugccagaagggcaacaucagaugcaacaucugcaucuga

SEQ ID NO: 159476 - RNA, 1701 nt, Artificial Sequence
  derived and/or modified sequence opt4 from hemagglutinin__InfluenzaA__AEK28872
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccauccaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 159477 - RNA, 1701 nt, Artificial Sequence
  derived and/or modified sequence opt4 from hemagglutinin__InfluenzaA__AEK28883
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugaucgccagcagcggcacccuggaguucaacaacgagagcuucaacuggaccggcgugacccagaacggcaccagcagcgccugcaucagaagaagcagcaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccauccaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 159478 - RNA, 1701 nt, Artificial Sequence
  derived and/or modified sequence opt4 from hemagglutinin__InfluenzaA__AEK28894
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccauccaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 159479 - RNA, 1701 nt, Artificial Sequence
  derived and/or modified sequence opt4 from hemagglutinin__InfluenzaA__AEK28905
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugagauucaaguaccccgcccugaacgugaccaugcccaacaacgagcaguucgacaagcuguacaucuggggcgugcaccaccccggcaccgacaacgaccagaucuuccccuacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 159480 - RNA, 1701 nt, Artificial Sequence
  derived and/or modified sequence opt4 from hemagglutinin__InfluenzaA__AEK28916
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcgugaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 159481 - RNA, 1701 nt, Artificial Sequence
  derived and/or modified sequence opt4 from hemagglutinin__InfluenzaA__AEK28927
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugaucgccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccauccaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 159482 - RNA, 1701 nt, Artificial Sequence
  derived and/or modified sequence opt4 from hemagglutinin__InfluenzaA__AEK28949
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugccugaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 159483 - RNA, 1701 nt, Artificial Sequence; identical to SEQ ID NO: 154954
  derived and/or modified sequence opt4 from hemagglutinin__InfluenzaA__AEK28960

SEQ ID NO: 159484 - RNA, 1701 nt, Artificial Sequence; identical to SEQ ID NO: 154954
  derived and/or modified sequence opt4 from hemagglutinin__InfluenzaA__AEK28971

SEQ ID NO: 159485 - RNA, 1701 nt, Artificial Sequence
  derived and/or modified sequence opt4 from hemagglutinin__InfluenzaA__AEK28982
augaagaccaucaucgcccugagcuacauccugugccugguguucgcccagaagcugcccggcaacuacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccauccaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 159486 - RNA, 1701 nt, Artificial Sequence
  derived and/or modified sequence opt4 from hemagglutinin__InfluenzaA__AEK28993
augaagaccaucaucgcccugagcuacauccugugccugguguucgcccagaagcugcccggcaacuacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 159487 - RNA, 1701 nt, Artificial Sequence
  derived and/or modified sequence opt4 from hemagglutinin__InfluenzaA__AEK29004
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgugagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 159488 - RNA, 1701 nt, Artificial Sequence
  derived and/or modified sequence opt4 from hemagglutinin__InfluenzaA__AEK29026
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccaggacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguacagcgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaugcagagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 159489 - RNA, 1701 nt, Artificial Sequence
  derived and/or modified sequence opt4 from hemagglutinin__InfluenzaA__AEK29048
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcguggcccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccgccggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 159490 - RNA, 1701 nt, Artificial Sequence
  derived and/or modified sequence opt4 from hemagglutinin__InfluenzaA__AEK29070
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccauccaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 159491 - RNA, 1701 nt, Artificial Sequence
  derived and/or modified sequence opt4 from hemagglutinin__InfluenzaA__AEK29081
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcagcugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccauccaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 159492 - RNA, 1701 nt, Artificial Sequence; identical to SEQ ID NO: 158053
  derived and/or modified sequence opt4 from hemagglutinin__InfluenzaA__AEK29092

SEQ ID NO: 159493 - RNA, 1701 nt, Artificial Sequence; identical to SEQ ID NO: 159375
  derived and/or modified sequence opt4 from hemagglutinin__InfluenzaA__AEK29125

SEQ ID NO: 159494 - RNA, 1701 nt, Artificial Sequence; identical to SEQ ID NO: 159375
  derived and/or modified sequence opt4 from hemagglutinin__InfluenzaA__AEK29136

SEQ ID NO: 159495 - RNA, 1701 nt, Artificial Sequence; identical to SEQ ID NO: 159375
  derived and/or modified sequence opt4 from hemagglutinin__InfluenzaA__AEK29169

SEQ ID NO: 159496 - RNA, 1701 nt, Artificial Sequence; identical to SEQ ID NO: 159375
  derived and/or modified sequence opt4 from hemagglutinin__InfluenzaA__AEK29180

SEQ ID NO: 159497 - RNA, 1701 nt, Artificial Sequence; identical to SEQ ID NO: 159375
  derived and/or modified sequence opt4 from hemagglutinin__InfluenzaA__AEK29191

SEQ ID NO: 159498 - RNA, 1701 nt, Artificial Sequence; identical to SEQ ID NO: 159375
  derived and/or modified sequence opt4 from hemagglutinin__InfluenzaA__AEK29202

SEQ ID NO: 159499 - RNA, 1701 nt, Artificial Sequence; identical to SEQ ID NO: 159375
  derived and/or modified sequence opt4 from hemagglutinin__InfluenzaA__AEK29213

SEQ ID NO: 159500 - RNA, 1701 nt, Artificial Sequence; identical to SEQ ID NO: 159375
  derived and/or modified sequence opt4 from hemagglutinin__InfluenzaA__AEK29224

SEQ ID NO: 159501 - RNA, 1701 nt, Artificial Sequence; identical to SEQ ID NO: 159375
  derived and/or modified sequence opt4 from hemagglutinin__InfluenzaA__AEK29235

SEQ ID NO: 159502 - RNA, 1701 nt, Artificial Sequence
  derived and/or modified sequence opt4 from hemagglutinin__InfluenzaA__AEK29268
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 159503 - RNA, 1698 nt, Artificial Sequence
  derived and/or modified sequence opt4 from hemagglutinin__InfluenzaA__AEK59838
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccgaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacaagaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcaagaaguucacccccgagaucgccaagagacccaaggugagagaccaggagggcagaaucaacuacuacuggacccugcuggagcccggcaacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 159504 - RNA, 1701 nt, Artificial Sequence
  derived and/or modified sequence opt4 from hemagglutinin__InfluenzaA__AEK98378
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccccuacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagauccagagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 159505 - RNA, 1701 nt, Artificial Sequence; identical to SEQ ID NO: 154435
  derived and/or modified sequence opt4 from hemagglutinin__InfluenzaA__AEK98380

SEQ ID NO: 159506 - RNA, 1701 nt, Artificial Sequence
  derived and/or modified sequence opt4 from hemagglutinin__InfluenzaA__AEK98382
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagauccagaucggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 159507 - RNA, 1701 nt, Artificial Sequence
  derived and/or modified sequence opt4 from hemagglutinin__InfluenzaA__AEK98386
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagaaccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 159508 - RNA, 1701 nt, Artificial Sequence
  derived and/or modified sequence opt4 from hemagglutinin__InfluenzaA__AEK98388
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggccugcagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgccauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 159509 - RNA, 1701 nt, Artificial Sequence
  derived and/or modified sequence opt4 from hemagglutinin__InfluenzaA__AEK98390
augaagaccaucaucgcccugagcuacauccugugccugguguucgcccaggagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgccugcaucacccccaacggcagcauccccaacgacaagaccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 159510 - RNA, 1701 nt, Artificial Sequence
  derived and/or modified sequence opt4 from hemagglutinin__InfluenzaA__AEK98392
augaagaccaucaucgcccugagcuacauccugugccugguguucgcccagaagcugcccggcaacgacaacagcaccgccacccugugccugggccaccacgccgugcccaacggcaccaucgugaagaccaucaccgacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagaacuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacugagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 159511 - RNA, 1701 nt, Artificial Sequence
  derived and/or modified sequence opt4 from hemagglutinin__InfluenzaA__AEK98394
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacugagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 159512 - RNA, 1701 nt, Artificial Sequence
  derived and/or modified sequence opt4 from hemagglutinin__InfluenzaA__AEK98396
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaagagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgcccugcugggcuucaucaugugggccugccagaagggcaacaucagaugcaacaucugcaucuga

SEQ ID NO: 159513 - RNA, 1701 nt, Artificial Sequence
  derived and/or modified sequence opt4 from hemagglutinin__InfluenzaA__AEK98398
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggccugcagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgccauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacauccccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggaucaucuggaucagcuucgccaucagcugcuuccugcugugcguggcccugcugggcuucaucaugugggccugccagaagggcaacaucagaugcaacaucugcaucuga

SEQ ID NO: 159514 - RNA, 1701 nt, Artificial Sequence
  derived and/or modified sequence opt4 from hemagglutinin__InfluenzaA__AEK98400
auggagaccaucaucgcccugagcuacauccugagccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagaacuucaacuggaccggcgugacccagaacggcaccagcagcgccugcaucagaagaagcaacaacagcuucuucagcagacugaacuggcugacccaccugagauucaaguaccccgcccugaacgugaccaugcccaacaacgaggaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagaucgagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 159515 - RNA, 1701 nt, Artificial Sequence
  derived and/or modified sequence opt4 from hemagglutinin__InfluenzaA__AEK98402
augaagaccaucaucgcccugagcuacauccugugccugggcuucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgccauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 159516 - RNA, 1701 nt, Artificial Sequence
  derived and/or modified sequence opt4 from hemagglutinin__InfluenzaA__AEK98404
augaagaccaucaucgcccugagcuacauccugagccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagaacuucaacuggaccggcgugacccagaacggcaccagcagcgccugcaucagaagaagcaacaacagcuucuucagcagacugaacuggcugacccaccugagauucaaguaccccgcccugaacgugaccaugcccaacaacgaggaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaugagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 159517 - RNA, 1701 nt, Artificial Sequence
  derived and/or modified sequence opt4 from hemagglutinin__InfluenzaA__AEK98406
augaagaccaucaucgcccugagcuacauccugagccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagaacuucaacuggaccggcgugacccagaacggcaccagcagcgccugcaucagaagaagcaacaacagcuucuucagcagacugaacuggcugacccaccugagauucaaguaccccgcccugaacgugaccaugcccaacaacgaggagcuggacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucgugaugugggccugccagaagggcaacaucagaugcaacaucugcaucuga

SEQ ID NO: 159518 - RNA, 1701 nt, Artificial Sequence
  derived and/or modified sequence opt4 from hemagglutinin__InfluenzaA__AEL11687
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcagcugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccgugaccgacaacgaccagaucagacuguacgcccaggccagcggcagaaucaccgugagcaccaagagaagccagcagaccgugauccccaacaucggcuacagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 159519 - RNA, 1692 nt, Artificial Sequence
  derived and/or modified sequence opt4 from hemagglutinin__InfluenzaA__AEL31632
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcaaccuggacggcgugaagccccugauccugagagacugcagcguggccggcuggcugcugggcaaccccaugugcgacgaguuccugaacgugcccgaguggagcuacaucguggagaagaucaaccccgccaacgaccugugcuaccccggcaacuucaacgacuacgaggagcugaagcaccugcugagcagaaucaaccacuucgagaagauccagaucauccccaagagcagcuggagcgaccacgaggccagcggcgugagcagcgugugccccuaccagggcagaagcagcuucuucagaaacgugguguggcugaccaagaaggacaacgccuaccccaccaucaagagaagcuacaacaacaccaaccaggaggaccugcuggugcuguggggcauccaccaccccaacgacgccgccgagcagaccagacuguaccagaaccccaccaccuacaucagcgugggcaccagcacccugaaccagagacuggugcccaagaucgccaccagaagcaaggugaacggccagagcggcagaauggaguucuucuggaccauccugaagagcaacgacgccaucaacuucgagagcaacggcaacuucaucgcccccgagaacgccuacaagaucgugaagaagggcgacagcaccaucaugaagagcgagcuggaguacggcaacugcaacaccaagugccagacccccaucggcgccaucaacagcagcaugcccuuccacaacauccacccccugaccaucggcgagugccccaaguacgugaagagcaacagacuggugcuggccaccggccugagaaacagcccccagggcgagaccagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccuguuccuguggaugugcagcaacggcagccugcagugcagaaucugcaucuga

SEQ ID NO: 159520 - RNA, 1701 nt, Artificial Sequence; identical to SEQ ID NO: 159440
  derived and/or modified sequence opt4 from hemagglutinin__InfluenzaA__AEL89297

SEQ ID NO: 159521 - RNA, 1701 nt, Artificial Sequence; identical to SEQ ID NO: 159440
  derived and/or modified sequence opt4 from hemagglutinin__InfluenzaA__AEL89307

SEQ ID NO: 159522 - RNA, 1701 nt, Artificial Sequence; identical to SEQ ID NO: 159440
  derived and/or modified sequence opt4 from hemagglutinin__InfluenzaA__AEL89317

SEQ ID NO: 159523 - RNA, 1701 nt, Artificial Sequence; identical to SEQ ID NO: 159440
  derived and/or modified sequence opt4 from hemagglutinin__InfluenzaA__AEL89327

SEQ ID NO: 159524 - RNA, 1701 nt, Artificial Sequence; identical to SEQ ID NO: 159440
  derived and/or modified sequence opt4 from hemagglutinin__InfluenzaA__AEL89337

SEQ ID NO: 159525 - RNA, 1701 nt, Artificial Sequence; identical to SEQ ID NO: 159440
  derived and/or modified sequence opt4 from hemagglutinin__InfluenzaA__AEL89347

SEQ ID NO: 159526 - RNA, 1701 nt, Artificial Sequence; identical to SEQ ID NO: 159440
  derived and/or modified sequence opt4 from hemagglutinin__InfluenzaA__AEL89357

SEQ ID NO: 159527 - RNA, 1701 nt, Artificial Sequence; identical to SEQ ID NO: 159440
  derived and/or modified sequence opt4 from hemagglutinin__InfluenzaA__AEL89367

SEQ ID NO: 159528 - RNA, 1701 nt, Artificial Sequence; identical to SEQ ID NO: 159440
  derived and/or modified sequence opt4 from hemagglutinin__InfluenzaA__AEL89391

SEQ ID NO: 159529 - RNA, 1701 nt, Artificial Sequence; identical to SEQ ID NO: 159440
  derived and/or modified sequence opt4 from hemagglutinin__InfluenzaA__AEL89401

SEQ ID NO: 159530 - RNA, 1701 nt, Artificial Sequence; identical to SEQ ID NO: 159440
  derived and/or modified sequence opt4 from hemagglutinin__InfluenzaA__AEL89411

SEQ ID NO: 159531 - RNA, 1701 nt, Artificial Sequence; identical to SEQ ID NO: 159440
  derived and/or modified sequence opt4 from hemagglutinin__InfluenzaA__AEL89421

SEQ ID NO: 159532 - RNA, 1701 nt, Artificial Sequence; identical to SEQ ID NO: 159440
  derived and/or modified sequence opt4 from hemagglutinin__InfluenzaA__AEL89441

SEQ ID NO: 159533 - RNA, 1701 nt, Artificial Sequence; identical to SEQ ID NO: 159440
  derived and/or modified sequence opt4 from hemagglutinin__InfluenzaA__AEL89451

SEQ ID NO: 159534 - RNA, 1701 nt, Artificial Sequence; identical to SEQ ID NO: 159440
  derived and/or modified sequence opt4 from hemagglutinin__InfluenzaA__AEL89461

SEQ ID NO: 159535 - RNA, 1701 nt, Artificial Sequence; identical to SEQ ID NO: 159440
  derived and/or modified sequence opt4 from hemagglutinin__InfluenzaA__AEL89471

SEQ ID NO: 159536 - RNA, 1701 nt, Artificial Sequence
  derived and/or modified sequence opt4 from hemagglutinin__InfluenzaA__AEL89481
augaaggugauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159537 - RNA, 1701 nt, Artificial Sequence; identical to SEQ ID NO: 158104
  derived and/or modified sequence opt4 from hemagglutinin__InfluenzaA__AEL89491

SEQ ID NO: 159538 - RNA, 1701 nt, Artificial Sequence
  derived and/or modified sequence opt4 from hemagglutinin__InfluenzaA__AEL89501
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccgaccacgacagcaacaagggcgugaccgccgccugcccccacgccggcgccaagagcuucuacaagaaccugaucuggcuggugaagaagggcaacagcuaccccaagcugagcaagagcuacaucaacgacgagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159539 - RNA, 1701 nt, Artificial Sequence; identical to SEQ ID NO: 156353
  derived and/or modified sequence opt4 from hemagglutinin__InfluenzaA__AEL89511

SEQ ID NO: 159540 - RNA, 1701 nt, Artificial Sequence; identical to SEQ ID NO: 158104
  derived and/or modified sequence opt4 from hemagglutinin__InfluenzaA__AEL89521

SEQ ID NO: 159541 - RNA, 1701 nt, Artificial Sequence
  derived and/or modified sequence opt4 from hemagglutinin__InfluenzaA__AEL89531
augaaggccauccugguggugcugcuguacaccuucaccaccgccaacgccgacacccugugcaucggcuaccacgccaacaacagcaccgacaccguggacaccgugcuggagaagaacgugaccgugacccacagcgugaaccugcuggaggacaagcacaacggcaagcugugccagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagauguuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159542 - RNA, 1701 nt, Artificial Sequence; identical to SEQ ID NO: 158104
  derived and/or modified sequence opt4 from hemagglutinin__InfluenzaA__AEL89541

SEQ ID NO: 159543 - RNA, 1701 nt, Artificial Sequence
  derived and/or modified sequence opt4 from hemagglutinin__InfluenzaA__AEL89551
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccgaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgcccacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159544 - RNA, 1701 nt, Artificial Sequence
  derived and/or modified sequence opt4 from hemagglutinin__InfluenzaA__AEL89561
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcggcaacggcaccugcuaccccggcgacuucaucgacuacgaggagcugagagagcagcugagcagcgugagcagcuucgagagauucgagaucuuccccaagaccagcagcuggcccgaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccgagaucuaccagauccuggccaucuacagcaccguggccagcagccuggugcugguggugagccugggcgccaucagcuucuggaugugcagcaacggcagccugcagugcagaaucugcaucuga

SEQ ID NO: 159545 - RNA, 1701 nt, Artificial Sequence; identical to SEQ ID NO: 158104
  derived and/or modified sequence opt4 from hemagglutinin__InfluenzaA__AEL89571

SEQ ID NO: 159546 - RNA, 1701 nt, Artificial Sequence
  derived and/or modified sequence opt4 from hemagglutinin__InfluenzaA__AEL89581
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagauguuccccaagaccagcagcuggcccgaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159547 - RNA, 1701 nt, Artificial Sequence; identical to SEQ ID NO: 158974
  derived and/or modified sequence opt4 from hemagglutinin__InfluenzaA__AEL89591

SEQ ID NO: 159548 - RNA, 1701 nt, Artificial Sequence
  derived and/or modified sequence opt4 from hemagglutinin__InfluenzaA__AEL89601
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccaccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccacccccccaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaaggugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159549 - RNA, 1701 nt, Artificial Sequence; identical to SEQ ID NO: 158974
  derived and/or modified sequence opt4 from hemagglutinin__InfluenzaA__AEL89611

SEQ ID NO: 159550 - RNA, 1701 nt, Artificial Sequence; identical to SEQ ID NO: 159416
  derived and/or modified sequence opt4 from hemagglutinin__InfluenzaA__AEL89621

SEQ ID NO: 159551 - RNA, 1701 nt, Artificial Sequence; identical to SEQ ID NO: 158104
  derived and/or modified sequence opt4 from hemagglutinin__InfluenzaA__AEL89631

SEQ ID NO: 159552 - RNA, 1701 nt, Artificial Sequence; identical to SEQ ID NO: 159440
  derived and/or modified sequence opt4 from hemagglutinin__InfluenzaA__AEL89641

SEQ ID NO: 159553 - RNA, 1701 nt, Artificial Sequence
  derived and/or modified sequence opt4 from hemagglutinin__InfluenzaA__AEL89651
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcguguucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguucgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159554 - RNA, 1701 nt, Artificial Sequence; identical to SEQ ID NO: 158955
  derived and/or modified sequence opt4 from hemagglutinin__InfluenzaA__AEL89661

SEQ ID NO: 159555 - RNA, 1701 nt, Artificial Sequence
  derived and/or modified sequence opt4 from hemagglutinin__InfluenzaA__AEL89671
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagagcgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159556 - RNA, 1701 nt, Artificial Sequence; identical to SEQ ID NO: 158955
  derived and/or modified sequence opt4 from hemagglutinin__InfluenzaA__AEL89691

SEQ ID NO: 159557 - RNA, 1701 nt, Artificial Sequence
  derived and/or modified sequence opt4 from hemagglutinin__InfluenzaA__AEL89701
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccaccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccacccccccaccagcgccgaccagcagaaccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacggcaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccaugaucuaccagauccuggccaucuacagcaccguggccagcagccuggugcugguggugagccugggcgccaucagcuucuggaugugcagcaacggcagccugcagugcagaaucugcaucuga

SEQ ID NO: 159558 - RNA, 1701 nt, Artificial Sequence; identical to SEQ ID NO: 159557
  derived and/or modified sequence opt4 from hemagglutinin__InfluenzaA__AEL89711

SEQ ID NO: 159559 - RNA, 1701 nt, Artificial Sequence; identical to SEQ ID NO: 158955
  derived and/or modified sequence opt4 from hemagglutinin__InfluenzaA__AEL89721

SEQ ID NO: 159560 - RNA, 1701 nt, Artificial Sequence
  derived and/or modified sequence opt4 from hemagglutinin__InfluenzaA__AEL89741
augaaggccauccugguggugcugcuguacaccuucgccaccaccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159561 - RNA, 1701 nt, Artificial Sequence; identical to SEQ ID NO: 158104
  derived and/or modified sequence opt4 from hemagglutinin__InfluenzaA__AEL89751

SEQ ID NO: 159562 - RNA, 1701 nt, Artificial Sequence
  derived and/or modified sequence opt4 from hemagglutinin__InfluenzaA__AEL89761
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccaccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccacccccccaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacggcaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccaugaucuaccagauccuggccaucuacagcaccguggccagcagccuggugcugguggugagccugggcgccaucagcuucuggaugugcagcaacggcagccugcagugcagaaucugcaucuga

SEQ ID NO: 159563 - RNA, 1701 nt, Artificial Sequence; identical to SEQ ID NO: 159440
  derived and/or modified sequence opt4 from hemagglutinin__InfluenzaA__AEL89771

SEQ ID NO: 159564 - RNA, 1701 nt, Artificial Sequence; identical to SEQ ID NO: 159562
  derived and/or modified sequence opt4 from hemagglutinin__InfluenzaA__AEL89781

SEQ ID NO: 159565 - RNA, 1701 nt, Artificial Sequence; identical to SEQ ID NO: 158955
  derived and/or modified sequence opt4 from hemagglutinin__InfluenzaA__AEL89791

SEQ ID NO: 159566 - RNA, 1701 nt, Artificial Sequence
  derived and/or modified sequence opt4 from hemagglutinin__InfluenzaA__AEL89801
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcguguucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccgugagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccugauccugguggugagccugggcgccaucagcuucuggaugugcagcaacggcagccugcagugcagaaucugcaucuga

SEQ ID NO: 159567 - RNA, 1701 nt, Artificial Sequence
  derived and/or modified sequence opt4 from hemagglutinin__InfluenzaA__AEL89812
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccaccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccacccccccaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacgccaccugccagacccccaagggcgugaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacggcaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccaugaucuaccagauccuggccaucuacagcaccguggccagcagccuggugcugguggugagccugggcgccaucagcuucuggaugugcagcaacggcagccugcagugcagaaucugcaucuga

SEQ ID NO: 159568 - RNA, 1701 nt, Artificial Sequence; identical to SEQ ID NO: 158955
  derived and/or modified sequence opt4 from hemagglutinin__InfluenzaA__AEL89832

SEQ ID NO: 159569 - RNA, 1701 nt, Artificial Sequence
  derived and/or modified sequence opt4 from hemagglutinin__InfluenzaA__AEL89842
augaaggccauccugguggugcugcuguacacccuggccaccgccaacgccgacacccugugcaucggcuaccacgccaacaacagcaccgacaccguggacaccgugcuggagaagaacgugaccgugacccacagcgugaaccugcuggaggacaagcacgacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacgccaccugccagacccccaagggcgccaucaacaccagccugcccuuccagaacgugcaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159570 - RNA, 1701 nt, Artificial Sequence
  derived and/or modified sequence opt4 from hemagglutinin__InfluenzaA__AEL89852
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcaaguacagcaagaaguucaagcccgagaucgccgugagacccaaggugagagaccaggagggcagaaugaacuacuacuggacccugguggagcccggcgacaagaucaccuucgaggccaccggcaaccugcuggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159571 - RNA, 1701 nt, Artificial Sequence; identical to SEQ ID NO: 158974
  derived and/or modified sequence opt4 from hemagglutinin__InfluenzaA__AEL93568

SEQ ID NO: 159572 - RNA, 1701 nt, Artificial Sequence; identical to SEQ ID NO: 158955
  derived and/or modified sequence opt4 from hemagglutinin__InfluenzaA__AEL93578

SEQ ID NO: 159573 - RNA, 1701 nt, Artificial Sequence
  derived and/or modified sequence opt4 from hemagglutinin__InfluenzaA__AEL93598
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcguguucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159574 - RNA, 1701 nt, Artificial Sequence
  derived and/or modified sequence opt4 from hemagglutinin__InfluenzaA__AEL93618
augaaggccauccugguggugaugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159575 - RNA, 1701 nt, Artificial Sequence; identical to SEQ ID NO: 158955
  derived and/or modified sequence opt4 from hemagglutinin__InfluenzaA__AEL93628

SEQ ID NO: 159576 - RNA, 1701 nt, Artificial Sequence; identical to SEQ ID NO: 159390
  derived and/or modified sequence opt4 from hemagglutinin__InfluenzaA__AEL93638

SEQ ID NO: 159577 - RNA, 1701 nt, Artificial Sequence
  derived and/or modified sequence opt4 from hemagglutinin__InfluenzaA__AEL94870
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccgaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgcccacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucaagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159578 - RNA, 1701 nt, Artificial Sequence
  derived and/or modified sequence opt4 from hemagglutinin__InfluenzaA__AEL95426
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaccagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159579 - RNA, 1701 nt, Artificial Sequence
  derived and/or modified sequence opt4 from hemagglutinin__InfluenzaA__AEL97631
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucaagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaccaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159580 - RNA, 1701 nt, Artificial Sequence
  derived and/or modified sequence opt4 from hemagglutinin__InfluenzaA__AEL99664
augaaggccauccugguggugcugcuguacaccuucgccaccgccaacgccgacacccugugcaucggcuaccacgccaacaacagcaccgacaccguggacaccauccuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucaagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacaccagcgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159581 - RNA, 1701 nt, Artificial Sequence
  derived and/or modified sequence opt4 from hemagglutinin__InfluenzaA__AEL99674
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaucuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159582 - RNA, 1689 nt, Artificial Sequence; identical to SEQ ID NO: 158791
  derived and/or modified sequence opt4 from hemagglutinin__InfluenzaA__AEM53455

SEQ ID NO: 159583 - RNA, 1689 nt, Artificial Sequence; identical to SEQ ID NO: 154140
  derived and/or modified sequence opt4 from hemagglutinin__InfluenzaA__AEM53468

SEQ ID NO: 159584 - RNA, 1698 nt, Artificial Sequence; identical to SEQ ID NO: 154635
  derived and/or modified sequence opt4 from hemagglutinin__InfluenzaA__AEM60037

SEQ ID NO: 159585 - RNA, 1698 nt, Artificial Sequence
  derived and/or modified sequence opt4 from hemagglutinin__InfluenzaA__AEM60058
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggagagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggacgugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugggcagaggcuucggcagcggcaucaucaccagcaacgcccccauggacaagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 159586 - RNA, 1701 nt, Artificial Sequence
  derived and/or modified sequence opt4 from hemagglutinin__InfluenzaA__AEM60069
augaagaccaucaucgcccugagcuacaucuucugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacgagaagugggaccuguucguggagagaagcaaggccuacagcaacugcuaccccuacgacgugcccgacuacgccagccugagaagccugguggccagcagcggcacccuggaguucaucaacgaggacuucaacuggaccggcgugacccagagcggcggcagcuacgccugcaagagaggcagcgugaagagcuucuucagcagacugaacuggcugcacgagagcgaguacaaguaccccgcccugaacgugaccaugcccaacaacggcaaguucgacaagcuguacaucuggggcgugcaccaccccagcaccgacagagagcagaccaaccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacaagaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 159587 - RNA, 1701 nt, Artificial Sequence
  derived and/or modified sequence opt4 from hemagglutinin__InfluenzaA__AEM92308
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagagaaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccgagaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggaggugggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccgccgccagcagccuggugcugguggugagccugggcgccaucagcuucuggaugugcagcaacggcagccugcagugcagaaucugcaucuga

SEQ ID NO: 159588 - RNA, 1701 nt, Artificial Sequence
  derived and/or modified sequence opt4 from hemagglutinin__InfluenzaA__AEM92318
augaaggccauccugguggugcugcuguacaccuucgccaccgccaacgccgacacccugugcaucggcuaccacgccaacaacagcaccgacaccguggacaccgugcuggagaagaacgugaccgugacccacagcguggaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgagaagagcuucuacaagaaccugaucuggcuggugaagaagggcaacagcuaccccaagcugaacaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccauccacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159589 - RNA, 1701 nt, Artificial Sequence
  derived and/or modified sequence opt4 from hemagglutinin__InfluenzaA__AEM92328
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugaacaucagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159590 - RNA, 1701 nt, Artificial Sequence
  derived and/or modified sequence opt4 from hemagglutinin__InfluenzaA__AEM92348
augaaggccauccugguggugcugcuguacaccuucgccaccgccaacgccgacacccugugcaucggcuaccacgccaacaacagcaccgacaccguggacaccgugcuggagaagaacgugaccgugacccacagcguggaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgagaagagcuucuacaagaaccugaucuggcuggugaagaagggcaacagcuaccccaagcugaacaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccauccacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugaagagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159591 - RNA, 1701 nt, Artificial Sequence
  derived and/or modified sequence opt4 from hemagglutinin__InfluenzaA__AEM92358
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaaggagggcaacagcuaccccaagcugagcaagagcuacaucaacgacaagggcaaggaggugcuggugcuguggggcauccaccaccccagcaccaccaccgaccagcagagccuguaccagaacgccgacgccuacguguucgugggcaccagcagauacagcaagaaguucaagcccgagaucgccaucagacccaagaugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159592 - RNA, 1701 nt, Artificial Sequence
  derived and/or modified sequence opt4 from hemagglutinin__InfluenzaA__AEM92368
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugaacaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159593 - RNA, 1701 nt, Artificial Sequence
  derived and/or modified sequence opt4 from hemagglutinin__InfluenzaA__AEM92378
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugaacagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugaacaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159594 - RNA, 1701 nt, Artificial Sequence
  derived and/or modified sequence opt4 from hemagglutinin__InfluenzaA__AEM92407
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccaacagcuggagcuacaucguggagaccagcagcagcgacaacggcaccugcuaccccggcgacuucaucgacuacgaggagcugagagagcagcugagcagcgugagcagcuucgagagauucgagaucuuccccaagaccaacagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcaccgaccagcagagccuguaccagaacgccgacgccuacguguucgugggcaccagcagauacagcaagaaguucaagcccgagaucgccaucagacccaaggugagaaaccaggagggcagaaugaacuacuacuggacccugguggagcccggcgacaagaucaccuucgaggccaccggcaaccugguggugcccagauacgccuucaccaucgagagaaacgccggcagcggcaucaucaucagcgacacccccauccacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggacccacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaugggcagccugcagugcagaaucugcaucuga

SEQ ID NO: 159595 - RNA, 1701 nt, Artificial Sequence
  derived and/or modified sequence opt4 from hemagglutinin__InfluenzaA__AEM92417
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaaggccagcagcuggcccaaccacgacagcaacaagggcgugaccgccgccugcccccacgccggcgccaagagcuucuacaagaaccugaucuggcuggugaagaaggagaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159596 - RNA, 1701 nt, Artificial Sequence
  derived and/or modified sequence opt4 from hemagglutinin__InfluenzaA__AEM92428
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaugugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159597 - RNA, 1701 nt, Artificial Sequence
  derived and/or modified sequence opt4 from hemagglutinin__InfluenzaA__AEM92438
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaagaucagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159598 - RNA, 1701 nt, Artificial Sequence; identical to SEQ ID NO: 159329
  derived and/or modified sequence opt4 from hemagglutinin__InfluenzaA__AEM92448

SEQ ID NO: 159599 - RNA, 1701 nt, Artificial Sequence; identical to SEQ ID NO: 159329
  derived and/or modified sequence opt4 from hemagglutinin__InfluenzaA__AEM92458

SEQ ID NO: 159600 - RNA, 1701 nt, Artificial Sequence
  derived and/or modified sequence opt4 from hemagglutinin__InfluenzaA__AEM92468
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcaaguacagcaaggaguucaagcccgagaucgccgugagacccaaggugagagaccaggagggcagaaugaacuacuacuggacccugguggagcccggcgacaagaucaccuucgaggccaccggcaaccugcuggugcccagauacgccuucgccauggagagaaacgccggcagcggcaucaucaucagcgacacccccgugcacgacugcaacaccaucugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159601 - RNA, 1701 nt, Artificial Sequence
  derived and/or modified sequence opt4 from hemagglutinin__InfluenzaA__AEM92478
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcaaguacagcaagaaguucaagcccgagaucgccgugagacccaaggugagagaccaggagggcagaaugaacuacuacuggacccugguggagcccggcgacaagaucaccuucgaggccaccggcaaccugcuggugcccagauacgccuucgccauggagagaaacgccggcagcggcaucaucaucagcgacacccccgugcacgacugcaacaccaucugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159602 - RNA, 1701 nt, Artificial Sequence
  derived and/or modified sequence opt4 from hemagglutinin__InfluenzaA__AEM92498
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccaacagcuggagcuacaucguggagaccagcagcagcgacaacggcaccugcuaccccggcgacuucaucgacuacgaggagcugagagagcagcugagcagcgugagcagcuucgagagauucgagaucuuccccaagaccaacagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgcccacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159603 - RNA, 1701 nt, Artificial Sequence
  derived and/or modified sequence opt4 from hemagglutinin__InfluenzaA__AEM92518
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccaccgccugcccccacgccggcgccaagagcuucuacaagaaccugaucuggcuggugaagaagggcaacagcuaccccaagcugagcaagagcuacaucaacgacaagagaaaggaggugcuggugcuguggggcauccaccacccccccaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacgccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaaggugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159604 - RNA, 1701 nt, Artificial Sequence
  derived and/or modified sequence opt4 from hemagglutinin__InfluenzaA__AEM92528
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugaacaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggccuucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159605 - RNA, 1701 nt, Artificial Sequence
  derived and/or modified sequence opt4 from hemagglutinin__InfluenzaA__AEM92548
augaaggccauccugguggugcugcuguacaccuucgccaccgccaccgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159606 - RNA, 1701 nt, Artificial Sequence
  derived and/or modified sequence opt4 from hemagglutinin__InfluenzaA__AEM92558
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcagcaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159607 - RNA, 1701 nt, Artificial Sequence; identical to SEQ ID NO: 159606
  derived and/or modified sequence opt4 from hemagglutinin__InfluenzaA__AEM92568

SEQ ID NO: 159608 - RNA, 1701 nt, Artificial Sequence
  derived and/or modified sequence opt4 from hemagglutinin__InfluenzaA__AEM92578
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcaucagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159609 - RNA, 1701 nt, Artificial Sequence
  derived and/or modified sequence opt4 from hemagglutinin__InfluenzaA__AEM92608
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159610 - RNA, 1701 nt, Artificial Sequence
  derived and/or modified sequence opt4 from hemagglutinin__InfluenzaA__AEM92618
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccaacagcuggagcuacaucguggagaccagcagcagcgacaacggcaccugcuaccccggcgacuucaucgacuacgaggagcugagagagcagcugagcagcgugagcagcuucgagagauucgagaucuuccccaagaccaacagcuggcccaaccacgacagcaacaagggcgugaccgccgccugcccccacgccggcgccaagagcuucuacaagaaccugaucuggcuggugaagaccggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcagaaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgcccacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159611 - RNA, 1701 nt, Artificial Sequence
  derived and/or modified sequence opt4 from hemagglutinin__InfluenzaA__AEM92638
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacaccaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagaagaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggaggugggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccgccgccagcagccuggugcugguggugagccugggcgccaucagcuucuggaugugcagcaacggcagccugcagugcagaaucugcaucuga

SEQ ID NO: 159612 - RNA, 1701 nt, Artificial Sequence
  derived and/or modified sequence opt4 from hemagglutinin__InfluenzaA__AEM92648
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacaccaacaagggcgugaccgccgccugcccccacgccggcgccaagagcuucuacaagaaccugaucuggcuggugaaggagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagaagaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggaggugggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccgccgccagcagccuggugcugguggugagccugggcgccaucagcuucuggaugugcagcaacggcagccugcagugcagaaucugcaucuga

SEQ ID NO: 159613 - RNA, 1701 nt, Artificial Sequence; identical to SEQ ID NO: 158053
  derived and/or modified sequence opt4 from hemagglutinin__InfluenzaA__AEM98407

SEQ ID NO: 159614 - RNA, 1701 nt, Artificial Sequence; identical to SEQ ID NO: 158053
  derived and/or modified sequence opt4 from hemagglutinin__InfluenzaA__AEM98418

SEQ ID NO: 159615 - RNA, 1701 nt, Artificial Sequence; identical to SEQ ID NO: 158053
  derived and/or modified sequence opt4 from hemagglutinin__InfluenzaA__AEM98429

SEQ ID NO: 159616 - RNA, 1701 nt, Artificial Sequence
  derived and/or modified sequence opt4 from hemagglutinin__InfluenzaA__AEN55398
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcaacuucaucgacuacgaggagcugagagagcagcugagcagcgugagcagcuucgagagauucgagaucuuccccaagaccagcagcuggcccgaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggcccccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggugaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159617 - RNA, 1701 nt, Artificial Sequence; identical to SEQ ID NO: 159440
  derived and/or modified sequence opt4 from hemagglutinin__InfluenzaA__AEN55408

SEQ ID NO: 159618 - RNA, 1701 nt, Artificial Sequence; identical to SEQ ID NO: 158955
  derived and/or modified sequence opt4 from hemagglutinin__InfluenzaA__AEN55418

SEQ ID NO: 159619 - RNA, 1701 nt, Artificial Sequence; identical to SEQ ID NO: 158104
  derived and/or modified sequence opt4 from hemagglutinin__InfluenzaA__AEN55463

SEQ ID NO: 159620 - RNA, 1701 nt, Artificial Sequence
  derived and/or modified sequence opt4 from hemagglutinin__InfluenzaA__AEN55473
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccaccgaccagcagagccuguaccagaccgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaccaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159621 - RNA, 1701 nt, Artificial Sequence; identical to SEQ ID NO: 158955
  derived and/or modified sequence opt4 from hemagglutinin__InfluenzaA__AEN55483

SEQ ID NO: 159622 - RNA, 1701 nt, Artificial Sequence; identical to SEQ ID NO: 159562
  derived and/or modified sequence opt4 from hemagglutinin__InfluenzaA__AEN55493

SEQ ID NO: 159623 - RNA, 1701 nt, Artificial Sequence; identical to SEQ ID NO: 158955
  derived and/or modified sequence opt4 from hemagglutinin__InfluenzaA__AEN55503

SEQ ID NO: 159624 - RNA, 1701 nt, Artificial Sequence
  derived and/or modified sequence opt4 from hemagglutinin__InfluenzaA__AEN55513
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagaaccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159625 - RNA, 1701 nt, Artificial Sequence; identical to SEQ ID NO: 158955
  derived and/or modified sequence opt4 from hemagglutinin__InfluenzaA__AEN55523

SEQ ID NO: 159626 - RNA, 1701 nt, Artificial Sequence; identical to SEQ ID NO: 157744
  derived and/or modified sequence opt4 from hemagglutinin__InfluenzaA__AEN68904

SEQ ID NO: 159627 - RNA, 1701 nt, Artificial Sequence; identical to SEQ ID NO: 155189
  derived and/or modified sequence opt4 from hemagglutinin__InfluenzaA__AEN68905

SEQ ID NO: 159628 - RNA, 1701 nt, Artificial Sequence; identical to SEQ ID NO: 155189
  derived and/or modified sequence opt4 from hemagglutinin__InfluenzaA__AEN68906

SEQ ID NO: 159629 - RNA, 1701 nt, Artificial Sequence; identical to SEQ ID NO: 156291
  derived and/or modified sequence opt4 from hemagglutinin__InfluenzaA__AEN68907

SEQ ID NO: 159630 - RNA, 1701 nt, Artificial Sequence; identical to SEQ ID NO: 155189
  derived and/or modified sequence opt4 from hemagglutinin__InfluenzaA__AEN68908

SEQ ID NO: 159631 - RNA, 1701 nt, Artificial Sequence
  derived and/or modified sequence opt4 from hemagglutinin__InfluenzaA__AEN68909
augaaggccauccugguggugcugcuguacaccuucgccaccgccaacgccgacacccugugcgugggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159632 - RNA, 1701 nt, Artificial Sequence
  derived and/or modified sequence opt4 from hemagglutinin__InfluenzaA__AEN68910
augaaggccauccugguggugcugcuguacaccuucgccaccgccaacgccgacacccugugcgugggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagggcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159633 - RNA, 1701 nt, Artificial Sequence; identical to SEQ ID NO: 157305
  derived and/or modified sequence opt4 from hemagglutinin__InfluenzaA__AEN68911

SEQ ID NO: 159634 - RNA, 1701 nt, Artificial Sequence; identical to SEQ ID NO: 155189
  derived and/or modified sequence opt4 from hemagglutinin__InfluenzaA__AEN68912

SEQ ID NO: 159635 - RNA, 1701 nt, Artificial Sequence; identical to SEQ ID NO: 155280
  derived and/or modified sequence opt4 from hemagglutinin__InfluenzaA__AEN68913

SEQ ID NO: 159636 - RNA, 1701 nt, Artificial Sequence; identical to SEQ ID NO: 157855
  derived and/or modified sequence opt4 from hemagglutinin__InfluenzaA__AEN68914

SEQ ID NO: 159637 - RNA, 1701 nt, Artificial Sequence; identical to SEQ ID NO: 155189
  derived and/or modified sequence opt4 from hemagglutinin__InfluenzaA__AEN68915

SEQ ID NO: 159638 - RNA, 1701 nt, Artificial Sequence; identical to SEQ ID NO: 155189
  derived and/or modified sequence opt4 from hemagglutinin__InfluenzaA__AEN68916

SEQ ID NO: 159639 - RNA, 1701 nt, Artificial Sequence
  derived and/or modified sequence opt4 from hemagglutinin__InfluenzaA__AEN68917
augaaggccauccugggcgugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccgugaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159640 - RNA, 1701 nt, Artificial Sequence
  derived and/or modified sequence opt4 from hemagglutinin__InfluenzaA__AEN68918
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagaacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagauguuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggaggugggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159641 - RNA, 1701 nt, Artificial Sequence; identical to SEQ ID NO: 158104
  derived and/or modified sequence opt4 from hemagglutinin__InfluenzaA__AEN68919

SEQ ID NO: 159642 - RNA, 1701 nt, Artificial Sequence; identical to SEQ ID NO: 157353
  derived and/or modified sequence opt4 from hemagglutinin__InfluenzaA__AEN68920

SEQ ID NO: 159643 - RNA, 1701 nt, Artificial Sequence; identical to SEQ ID NO: 156353
  derived and/or modified sequence opt4 from hemagglutinin__InfluenzaA__AEN68921

SEQ ID NO: 159644 - RNA, 1701 nt, Artificial Sequence; identical to SEQ ID NO: 156349
  derived and/or modified sequence opt4 from hemagglutinin__InfluenzaA__AEN68922

SEQ ID NO: 159645 - RNA, 1701 nt, Artificial Sequence; identical to SEQ ID NO: 156353
  derived and/or modified sequence opt4 from hemagglutinin__InfluenzaA__AEN68923

SEQ ID NO: 159646 - RNA, 1701 nt, Artificial Sequence; identical to SEQ ID NO: 156353
  derived and/or modified sequence opt4 from hemagglutinin__InfluenzaA__AEN68924

SEQ ID NO: 159647 - RNA, 1701 nt, Artificial Sequence
  derived and/or modified sequence opt4 from hemagglutinin__InfluenzaA__AEN68925
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucguggagaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159648 - RNA, 1701 nt, Artificial Sequence
  derived and/or modified sequence opt4 from hemagglutinin__InfluenzaA__AEN68926
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccuggccaccgccagcagcuggagcuacaucguggagaccagcaacagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcagagaggugcuggugcuguggggcauccaccaccccagcaccagcgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159649 - RNA, 1701 nt, Artificial Sequence
  derived and/or modified sequence opt4 from hemagglutinin__InfluenzaA__AEN68927
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccgaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159650 - RNA, 1701 nt, Artificial Sequence; identical to SEQ ID NO: 158775
  derived and/or modified sequence opt4 from hemagglutinin__InfluenzaA__AEN68928

SEQ ID NO: 159651 - RNA, 1701 nt, Artificial Sequence
  derived and/or modified sequence opt4 from hemagglutinin__InfluenzaA__AEN68929
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcaucgccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159652 - RNA, 1701 nt, Artificial Sequence; identical to SEQ ID NO: 158104
  derived and/or modified sequence opt4 from hemagglutinin__InfluenzaA__AEN68930

SEQ ID NO: 159653 - RNA, 1701 nt, Artificial Sequence; identical to SEQ ID NO: 158104
  derived and/or modified sequence opt4 from hemagglutinin__InfluenzaA__AEN68931

SEQ ID NO: 159654 - RNA, 1701 nt, Artificial Sequence; identical to SEQ ID NO: 158104
  derived and/or modified sequence opt4 from hemagglutinin__InfluenzaA__AEN68932

SEQ ID NO: 159655 - RNA, 1701 nt, Artificial Sequence
  derived and/or modified sequence opt4 from hemagglutinin__InfluenzaA__AEN69426
augaaggccauccugguggugcugcuguacaccuucgccaccagcaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcaacuucaucgacuacgaggagcugagagagcagcugagcagcgugagcagcuucgagagauucgagaucuuccccaagaccagcagcuggcccgaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggcccccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159656 - RNA, 1701 nt, Artificial Sequence; identical to SEQ ID NO: 159440
  derived and/or modified sequence opt4 from hemagglutinin__InfluenzaA__AEN69475

SEQ ID NO: 159657 - RNA, 1701 nt, Artificial Sequence; identical to SEQ ID NO: 159440
  derived and/or modified sequence opt4 from hemagglutinin__InfluenzaA__AEN69481

SEQ ID NO: 159658 - RNA, 1701 nt, Artificial Sequence; identical to SEQ ID NO: 155442
  derived and/or modified sequence opt4 from hemagglutinin__InfluenzaA__AEO01032

SEQ ID NO: 159659 - RNA, 1701 nt, Artificial Sequence; identical to SEQ ID NO: 155542
  derived and/or modified sequence opt4 from hemagglutinin__InfluenzaA__AEO01033

SEQ ID NO: 159660 - RNA, 1701 nt, Artificial Sequence; identical to SEQ ID NO: 155542
  derived and/or modified sequence opt4 from hemagglutinin__InfluenzaA__AEO01034

SEQ ID NO: 159661 - RNA, 1701 nt, Artificial Sequence; identical to SEQ ID NO: 155176
  derived and/or modified sequence opt4 from hemagglutinin__InfluenzaA__AEO01035

SEQ ID NO: 159662 - RNA, 1701 nt, Artificial Sequence; identical to SEQ ID NO: 155542
  derived and/or modified sequence opt4 from hemagglutinin__InfluenzaA__AEO01036

SEQ ID NO: 159663 - RNA, 1701 nt, Artificial Sequence; identical to SEQ ID NO: 155431
  derived and/or modified sequence opt4 from hemagglutinin__InfluenzaA__AEO01037

SEQ ID NO: 159664 - RNA, 1701 nt, Artificial Sequence; identical to SEQ ID NO: 155542
  derived and/or modified sequence opt4 from hemagglutinin__InfluenzaA__AEO01038

SEQ ID NO: 159665 - RNA, 1701 nt, Artificial Sequence; identical to SEQ ID NO: 155369
  derived and/or modified sequence opt4 from hemagglutinin__InfluenzaA__AEO01039

SEQ ID NO: 159666 - RNA, 1701 nt, Artificial Sequence
  derived and/or modified sequence opt4 from hemagglutinin__InfluenzaA__AEO01040
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaagaaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugaucgagcccggcgacaagaucaccuucgaggccaccggcaaccugguggugcccagauacgccuucaccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159667 - RNA, 1701 nt, Artificial Sequence; identical to SEQ ID NO: 155189
  derived and/or modified sequence opt4 from hemagglutinin__InfluenzaA__AEO01041

SEQ ID NO: 159668 - RNA, 1701 nt, Artificial Sequence; identical to SEQ ID NO: 155542
  derived and/or modified sequence opt4 from hemagglutinin__InfluenzaA__AEO01042

SEQ ID NO: 159669 - RNA, 1701 nt, Artificial Sequence
  derived and/or modified sequence opt4 from hemagglutinin__InfluenzaA__AEO01043
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcaacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159670 - RNA, 1701 nt, Artificial Sequence; identical to SEQ ID NO: 155189
  derived and/or modified sequence opt4 from hemagglutinin__InfluenzaA__AEO01044

SEQ ID NO: 159671 - RNA, 1701 nt, Artificial Sequence
  derived and/or modified sequence opt4 from hemagglutinin__InfluenzaA__AEO01045
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccuggagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159672 - RNA, 1701 nt, Artificial Sequence; identical to SEQ ID NO: 155189
  derived and/or modified sequence opt4 from hemagglutinin__InfluenzaA__AEO01046

SEQ ID NO: 159673 - RNA, 1701 nt, Artificial Sequence; identical to SEQ ID NO: 155189
  derived and/or modified sequence opt4 from hemagglutinin__InfluenzaA__AEO01047

SEQ ID NO: 159674 - RNA, 1701 nt, Artificial Sequence
  derived and/or modified sequence opt4 from hemagglutinin__InfluenzaA__AEO01048
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcaagaucugcaucuga

SEQ ID NO: 159675 - RNA, 1701 nt, Artificial Sequence; identical to SEQ ID NO: 156087
  derived and/or modified sequence opt4 from hemagglutinin__InfluenzaA__AEO01049

SEQ ID NO: 159676 - RNA, 1701 nt, Artificial Sequence; identical to SEQ ID NO: 155189
  derived and/or modified sequence opt4 from hemagglutinin__InfluenzaA__AEO01050

SEQ ID NO: 159677 - RNA, 1701 nt, Artificial Sequence; identical to SEQ ID NO: 155542
  derived and/or modified sequence opt4 from hemagglutinin__InfluenzaA__AEO01051

SEQ ID NO: 159678 - RNA, 1701 nt, Artificial Sequence
  derived and/or modified sequence opt4 from hemagglutinin__InfluenzaA__AEO01052
augaaggccaucaucguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159679 - RNA, 1701 nt, Artificial Sequence; identical to SEQ ID NO: 155542
  derived and/or modified sequence opt4 from hemagglutinin__InfluenzaA__AEO01053

SEQ ID NO: 159680 - RNA, 1701 nt, Artificial Sequence; identical to SEQ ID NO: 155189
  derived and/or modified sequence opt4 from hemagglutinin__InfluenzaA__AEO01054

SEQ ID NO: 159681 - RNA, 1701 nt, Artificial Sequence; identical to SEQ ID NO: 156001
  derived and/or modified sequence opt4 from hemagglutinin__InfluenzaA__AEO01055

SEQ ID NO: 159682 - RNA, 1701 nt, Artificial Sequence; identical to SEQ ID NO: 155542
  derived and/or modified sequence opt4 from hemagglutinin__InfluenzaA__AEO01056

SEQ ID NO: 159683 - RNA, 1701 nt, Artificial Sequence; identical to SEQ ID NO: 155189
  derived and/or modified sequence opt4 from hemagglutinin__InfluenzaA__AEO01057

SEQ ID NO: 159684 - RNA, 1701 nt, Artificial Sequence; identical to SEQ ID NO: 155189
  derived and/or modified sequence opt4 from hemagglutinin__InfluenzaA__AEO01058

SEQ ID NO: 159685 - RNA, 1701 nt, Artificial Sequence; identical to SEQ ID NO: 155189
  derived and/or modified sequence opt4 from hemagglutinin__InfluenzaA__AEO01059

SEQ ID NO: 159686 - RNA, 1701 nt, Artificial Sequence; identical to SEQ ID NO: 155189
  derived and/or modified sequence opt4 from hemagglutinin__InfluenzaA__AEO01060

SEQ ID NO: 159687 - RNA, 1701 nt, Artificial Sequence; identical to SEQ ID NO: 155189
  derived and/or modified sequence opt4 from hemagglutinin__InfluenzaA__AEO01061

SEQ ID NO: 159688 - RNA, 1701 nt, Artificial Sequence; identical to SEQ ID NO: 155189
  derived and/or modified sequence opt4 from hemagglutinin__InfluenzaA__AEO01062

SEQ ID NO: 159689 - RNA, 1701 nt, Artificial Sequence; identical to SEQ ID NO: 155189
  derived and/or modified sequence opt4 from hemagglutinin__InfluenzaA__AEO01063

SEQ ID NO: 159690 - RNA, 1701 nt, Artificial Sequence; identical to SEQ ID NO: 155189
  derived and/or modified sequence opt4 from hemagglutinin__InfluenzaA__AEO01064

SEQ ID NO: 159691 - RNA, 1701 nt, Artificial Sequence; identical to SEQ ID NO: 155431
  derived and/or modified sequence opt4 from hemagglutinin__InfluenzaA__AEO01065

SEQ ID NO: 159692 - RNA, 1701 nt, Artificial Sequence; identical to SEQ ID NO: 155542
  derived and/or modified sequence opt4 from hemagglutinin__InfluenzaA__AEO01066

SEQ ID NO: 159693 - RNA, 1701 nt, Artificial Sequence
  derived and/or modified sequence opt4 from hemagglutinin__InfluenzaA__AEO01067
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagauggccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159694 - RNA, 1701 nt, Artificial Sequence; identical to SEQ ID NO: 155542
  derived and/or modified sequence opt4 from hemagglutinin__InfluenzaA__AEO01068

SEQ ID NO: 159695 - RNA, 1701 nt, Artificial Sequence; identical to SEQ ID NO: 155189
  derived and/or modified sequence opt4 from hemagglutinin__InfluenzaA__AEO01069

SEQ ID NO: 159696 - RNA, 1701 nt, Artificial Sequence; identical to SEQ ID NO: 155542
  derived and/or modified sequence opt4 from hemagglutinin__InfluenzaA__AEO01070

SEQ ID NO: 159697 - RNA, 1701 nt, Artificial Sequence; identical to SEQ ID NO: 155189
  derived and/or modified sequence opt4 from hemagglutinin__InfluenzaA__AEO01071

SEQ ID NO: 159698 - RNA, 1701 nt, Artificial Sequence
  derived and/or modified sequence opt4 from hemagglutinin__InfluenzaA__AEO01073
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccgugaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159699 - RNA, 1701 nt, Artificial Sequence; identical to SEQ ID NO: 155431
  derived and/or modified sequence opt4 from hemagglutinin__InfluenzaA__AEO01074

SEQ ID NO: 159700 - RNA, 1701 nt, Artificial Sequence; identical to SEQ ID NO: 155542
  derived and/or modified sequence opt4 from hemagglutinin__InfluenzaA__AEO01075

SEQ ID NO: 159701 - RNA, 1701 nt, Artificial Sequence; identical to SEQ ID NO: 155542
  derived and/or modified sequence opt4 from hemagglutinin__InfluenzaA__AEO01076

SEQ ID NO: 159702 - RNA, 1701 nt, Artificial Sequence
  derived and/or modified sequence opt4 from hemagglutinin__InfluenzaA__AEO01077
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagaacgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159703 - RNA, 1701 nt, Artificial Sequence; identical to SEQ ID NO: 155189
  derived and/or modified sequence opt4 from hemagglutinin__InfluenzaA__AEO01078

SEQ ID NO: 159704 - RNA, 1701 nt, Artificial Sequence; identical to SEQ ID NO: 155189
  derived and/or modified sequence opt4 from hemagglutinin__InfluenzaA__AEO01079

SEQ ID NO: 159705 - RNA, 1701 nt, Artificial Sequence; identical to SEQ ID NO: 155189
  derived and/or modified sequence opt4 from hemagglutinin__InfluenzaA__AEO01080

SEQ ID NO: 159706 - RNA, 1701 nt, Artificial Sequence; identical to SEQ ID NO: 155542
  derived and/or modified sequence opt4 from hemagglutinin__InfluenzaA__AEO01081

SEQ ID NO: 159707 - RNA, 1701 nt, Artificial Sequence; identical to SEQ ID NO: 155189
  derived and/or modified sequence opt4 from hemagglutinin__InfluenzaA__AEO01082

SEQ ID NO: 159708 - RNA, 1701 nt, Artificial Sequence; identical to SEQ ID NO: 155189
  derived and/or modified sequence opt4 from hemagglutinin__InfluenzaA__AEO01083

SEQ ID NO: 159709 - RNA, 1701 nt, Artificial Sequence; identical to SEQ ID NO: 155189
  derived and/or modified sequence opt4 from hemagglutinin__InfluenzaA__AEO01084

SEQ ID NO: 159710 - RNA, 1701 nt, Artificial Sequence; identical to SEQ ID NO: 155542
  derived and/or modified sequence opt4 from hemagglutinin__InfluenzaA__AEO01085

SEQ ID NO: 159711 - RNA, 1701 nt, Artificial Sequence; identical to SEQ ID NO: 155189
  derived and/or modified sequence opt4 from hemagglutinin__InfluenzaA__AEO01086

SEQ ID NO: 159712 - RNA, 1701 nt, Artificial Sequence; identical to SEQ ID NO: 155542
  derived and/or modified sequence opt4 from hemagglutinin__InfluenzaA__AEO01087

SEQ ID NO: 159713 - RNA, 1701 nt, Artificial Sequence; identical to SEQ ID NO: 155369
  derived and/or modified sequence opt4 from hemagglutinin__InfluenzaA__AEO01088

SEQ ID NO: 159714 - RNA, 1701 nt, Artificial Sequence; identical to SEQ ID NO: 155542
  derived and/or modified sequence opt4 from hemagglutinin__InfluenzaA__AEO01089

SEQ ID NO: 159715 - RNA, 1701 nt, Artificial Sequence; identical to SEQ ID NO: 155542
  derived and/or modified sequence opt4 from hemagglutinin__InfluenzaA__AEO01090

SEQ ID NO: 159716 - RNA, 1701 nt, Artificial Sequence; identical to SEQ ID NO: 155542
  derived and/or modified sequence opt4 from hemagglutinin__InfluenzaA__AEO01091

SEQ ID NO: 159717 - RNA, 1701 nt, Artificial Sequence
  derived and/or modified sequence opt4 from hemagglutinin__InfluenzaA__AEO01092
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagagagugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159718 - RNA, 1701 nt, Artificial Sequence; identical to SEQ ID NO: 155189
  derived and/or modified sequence opt4 from hemagglutinin__InfluenzaA__AEO01093

SEQ ID NO: 159719 - RNA, 1701 nt, Artificial Sequence; identical to SEQ ID NO: 155189
  derived and/or modified sequence opt4 from hemagglutinin__InfluenzaA__AEO01094

SEQ ID NO: 159720 - RNA, 1701 nt, Artificial Sequence; identical to SEQ ID NO: 158396
  derived and/or modified sequence opt4 from hemagglutinin__InfluenzaA__AEO01095

SEQ ID NO: 159721 - RNA, 1701 nt, Artificial Sequence; identical to SEQ ID NO: 155542
  derived and/or modified sequence opt4 from hemagglutinin__InfluenzaA__AEO01096

SEQ ID NO: 159722 - RNA, 1701 nt, Artificial Sequence; identical to SEQ ID NO: 155542
  derived and/or modified sequence opt4 from hemagglutinin__InfluenzaA__AEO01097

SEQ ID NO: 159723 - RNA, 1701 nt, Artificial Sequence; identical to SEQ ID NO: 155542
  derived and/or modified sequence opt4 from hemagglutinin__InfluenzaA__AEO01098

SEQ ID NO: 159724 - RNA, 1701 nt, Artificial Sequence; identical to SEQ ID NO: 155189
  derived and/or modified sequence opt4 from hemagglutinin__InfluenzaA__AEO01099

SEQ ID NO: 159725 - RNA, 1701 nt, Artificial Sequence; identical to SEQ ID NO: 155431
  derived and/or modified sequence opt4 from hemagglutinin__InfluenzaA__AEO01100

SEQ ID NO: 159726 - RNA, 1701 nt, Artificial Sequence; identical to SEQ ID NO: 155189
  derived and/or modified sequence opt4 from hemagglutinin__InfluenzaA__AEO01101

SEQ ID NO: 159727 - RNA, 1701 nt, Artificial Sequence; identical to SEQ ID NO: 155189
  derived and/or modified sequence opt4 from hemagglutinin__InfluenzaA__AEO01102

SEQ ID NO: 159728 - RNA, 1701 nt, Artificial Sequence; identical to SEQ ID NO: 155542
  derived and/or modified sequence opt4 from hemagglutinin__InfluenzaA__AEO01103

SEQ ID NO: 159729 - RNA, 1701 nt, Artificial Sequence; identical to SEQ ID NO: 155542
  derived and/or modified sequence opt4 from hemagglutinin__InfluenzaA__AEO01104

SEQ ID NO: 159730 - RNA, 1701 nt, Artificial Sequence
  derived and/or modified sequence opt4 from hemagglutinin__InfluenzaA__AEO01105
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcagcaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159731 - RNA, 1701 nt, Artificial Sequence; identical to SEQ ID NO: 155542
  derived and/or modified sequence opt4 from hemagglutinin__InfluenzaA__AEO01106

SEQ ID NO: 159732 - RNA, 1701 nt, Artificial Sequence; identical to SEQ ID NO: 155189
  derived and/or modified sequence opt4 from hemagglutinin__InfluenzaA__AEO01107

SEQ ID NO: 159733 - RNA, 1701 nt, Artificial Sequence; identical to SEQ ID NO: 155189
  derived and/or modified sequence opt4 from hemagglutinin__InfluenzaA__AEO01108

SEQ ID NO: 159734 - RNA, 1701 nt, Artificial Sequence; identical to SEQ ID NO: 155189
  derived and/or modified sequence opt4 from hemagglutinin__InfluenzaA__AEO01109

SEQ ID NO: 159735 - RNA, 1701 nt, Artificial Sequence; identical to SEQ ID NO: 155189
  derived and/or modified sequence opt4 from hemagglutinin__InfluenzaA__AEO01110

SEQ ID NO: 159736 - RNA, 1701 nt, Artificial Sequence; identical to SEQ ID NO: 155189
  derived and/or modified sequence opt4 from hemagglutinin__InfluenzaA__AEO01111

SEQ ID NO: 159737 - RNA, 1701 nt, Artificial Sequence; identical to SEQ ID NO: 155189
  derived and/or modified sequence opt4 from hemagglutinin__InfluenzaA__AEO01112

SEQ ID NO: 159738 - RNA, 1701 nt, Artificial Sequence
  derived and/or modified sequence opt4 from hemagglutinin__InfluenzaA__AEO01113
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugccugcacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159739 - RNA, 1701 nt, Artificial Sequence; identical to SEQ ID NO: 155431
  derived and/or modified sequence opt4 from hemagglutinin__InfluenzaA__AEO01114

SEQ ID NO: 159740 - RNA, 1701 nt, Artificial Sequence
  derived and/or modified sequence opt4 from hemagglutinin__InfluenzaA__AEO01115
auggaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugccugcacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccacaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159741 - RNA, 1701 nt, Artificial Sequence; identical to SEQ ID NO: 155189
  derived and/or modified sequence opt4 from hemagglutinin__InfluenzaA__AEO01116

SEQ ID NO: 159742 - RNA, 1701 nt, Artificial Sequence; identical to SEQ ID NO: 155189
  derived and/or modified sequence opt4 from hemagglutinin__InfluenzaA__AEO01117

SEQ ID NO: 159743 - RNA, 1701 nt, Artificial Sequence; identical to SEQ ID NO: 156055
  derived and/or modified sequence opt4 from hemagglutinin__InfluenzaA__AEO01118

SEQ ID NO: 159744 - RNA, 1701 nt, Artificial Sequence; identical to SEQ ID NO: 155189
  derived and/or modified sequence opt4 from hemagglutinin__InfluenzaA__AEO01119

SEQ ID NO: 159745 - RNA, 1701 nt, Artificial Sequence
  derived and/or modified sequence opt4 from hemagglutinin__InfluenzaA__AEO01120
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacguguggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159746 - RNA, 1701 nt, Artificial Sequence; identical to SEQ ID NO: 155189
  derived and/or modified sequence opt4 from hemagglutinin__InfluenzaA__AEO01121

SEQ ID NO: 159747 - RNA, 1701 nt, Artificial Sequence; identical to SEQ ID NO: 155542
  derived and/or modified sequence opt4 from hemagglutinin__InfluenzaA__AEO01122

SEQ ID NO: 159748 - RNA, 1701 nt, Artificial Sequence; identical to SEQ ID NO: 155189
  derived and/or modified sequence opt4 from hemagglutinin__InfluenzaA__AEO01123

SEQ ID NO: 159749 - RNA, 1701 nt, Artificial Sequence; identical to SEQ ID NO: 155189
  derived and/or modified sequence opt4 from hemagglutinin__InfluenzaA__AEO01124

SEQ ID NO: 159750 - RNA, 1701 nt, Artificial Sequence; identical to SEQ ID NO: 155542
  derived and/or modified sequence opt4 from hemagglutinin__InfluenzaA__AEO01125

SEQ ID NO: 159751 - RNA, 1701 nt, Artificial Sequence
  derived and/or modified sequence opt4 from hemagglutinin__InfluenzaA__AEO01126
augaaggccacccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159752 - RNA, 1701 nt, Artificial Sequence; identical to SEQ ID NO: 155189
  derived and/or modified sequence opt4 from hemagglutinin__InfluenzaA__AEO01127

SEQ ID NO: 159753 - RNA, 1701 nt, Artificial Sequence; identical to SEQ ID NO: 155189
  derived and/or modified sequence opt4 from hemagglutinin__InfluenzaA__AEO01128

SEQ ID NO: 159754 - RNA, 1701 nt, Artificial Sequence; identical to SEQ ID NO: 155542
  derived and/or modified sequence opt4 from hemagglutinin__InfluenzaA__AEO01129

SEQ ID NO: 159755 - RNA, 1701 nt, Artificial Sequence; identical to SEQ ID NO: 155189
  derived and/or modified sequence opt4 from hemagglutinin__InfluenzaA__AEO01130

SEQ ID NO: 159756 - RNA, 1701 nt, Artificial Sequence; identical to SEQ ID NO: 155542
  derived and/or modified sequence opt4 from hemagglutinin__InfluenzaA__AEO01131

SEQ ID NO: 159757 - RNA, 1701 nt, Artificial Sequence; identical to SEQ ID NO: 155189
  derived and/or modified sequence opt4 from hemagglutinin__InfluenzaA__AEO01132

SEQ ID NO: 159758 - RNA, 1701 nt, Artificial Sequence
  derived and/or modified sequence opt4 from hemagglutinin__InfluenzaA__AEO01133
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccaugaucuaccagauccuggccaucuacagcaccguggccagcagccuggugcugguggugagccugggcgccaucagcuucuggaugugcagcaacggcagccugcagugcagaaucugcaucuga

SEQ ID NO: 159759 - RNA, 1701 nt, Artificial Sequence; identical to SEQ ID NO: 155542
  derived and/or modified sequence opt4 from hemagglutinin__InfluenzaA__AEO01134

SEQ ID NO: 159760 - RNA, 1701 nt, Artificial Sequence; identical to SEQ ID NO: 155542
  derived and/or modified sequence opt4 from hemagglutinin__InfluenzaA__AEO01135

SEQ ID NO: 159761 - RNA, 1701 nt, Artificial Sequence; identical to SEQ ID NO: 155189
  derived and/or modified sequence opt4 from hemagglutinin__InfluenzaA__AEO01136

SEQ ID NO: 159762 - RNA, 1701 nt, Artificial Sequence; identical to SEQ ID NO: 155636
  derived and/or modified sequence opt4 from hemagglutinin__InfluenzaA__AEO01137

SEQ ID NO: 159763 - RNA, 1701 nt, Artificial Sequence; identical to SEQ ID NO: 155636
  derived and/or modified sequence opt4 from hemagglutinin__InfluenzaA__AEO01138

SEQ ID NO: 159764 - RNA, 1701 nt, Artificial Sequence; identical to SEQ ID NO: 155189
  derived and/or modified sequence opt4 from hemagglutinin__InfluenzaA__AEO01139

SEQ ID NO: 159765 - RNA, 1701 nt, Artificial Sequence; identical to SEQ ID NO: 155189
  derived and/or modified sequence opt4 from hemagglutinin__InfluenzaA__AEO01140

SEQ ID NO: 159766 - RNA, 1701 nt, Artificial Sequence; identical to SEQ ID NO: 155189
  derived and/or modified sequence opt4 from hemagglutinin__InfluenzaA__AEO01141

SEQ ID NO: 159767 - RNA, 1701 nt, Artificial Sequence; identical to SEQ ID NO: 155189
  derived and/or modified sequence opt4 from hemagglutinin__InfluenzaA__AEO01142

SEQ ID NO: 159768 - RNA, 1701 nt, Artificial Sequence
  derived and/or modified sequence opt4 from hemagglutinin__InfluenzaA__AEO01144
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcaucagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159769 - RNA, 1701 nt, Artificial Sequence; identical to SEQ ID NO: 155369
  derived and/or modified sequence opt4 from hemagglutinin__InfluenzaA__AEO01145

SEQ ID NO: 159770 - RNA, 1701 nt, Artificial Sequence
  derived and/or modified sequence opt4 from hemagglutinin__InfluenzaA__AEO01146
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaaccccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159771 - RNA, 1701 nt, Artificial Sequence; identical to SEQ ID NO: 155189
  derived and/or modified sequence opt4 from hemagglutinin__InfluenzaA__AEO01147

SEQ ID NO: 159772 - RNA, 1701 nt, Artificial Sequence; identical to SEQ ID NO: 155542
  derived and/or modified sequence opt4 from hemagglutinin__InfluenzaA__AEO01148

SEQ ID NO: 159773 - RNA, 1701 nt, Artificial Sequence; identical to SEQ ID NO: 155542
  derived and/or modified sequence opt4 from hemagglutinin__InfluenzaA__AEO01149

SEQ ID NO: 159774 - RNA, 1701 nt, Artificial Sequence; identical to SEQ ID NO: 158396
  derived and/or modified sequence opt4 from hemagglutinin__InfluenzaA__AEO01150

SEQ ID NO: 159775 - RNA, 1701 nt, Artificial Sequence; identical to SEQ ID NO: 155189
  derived and/or modified sequence opt4 from hemagglutinin__InfluenzaA__AEO01151

SEQ ID NO: 159776 - RNA, 1701 nt, Artificial Sequence
  derived and/or modified sequence opt4 from hemagglutinin__InfluenzaA__AEO01152
augaaggccauccugaucgugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagaggccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159777 - RNA, 1701 nt, Artificial Sequence
  derived and/or modified sequence opt4 from hemagglutinin__InfluenzaA__AEO01153
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacaacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcaacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159778 - RNA, 1701 nt, Artificial Sequence; identical to SEQ ID NO: 155189
  derived and/or modified sequence opt4 from hemagglutinin__InfluenzaA__AEO01154

SEQ ID NO: 159779 - RNA, 1701 nt, Artificial Sequence; identical to SEQ ID NO: 155542
  derived and/or modified sequence opt4 from hemagglutinin__InfluenzaA__AEO01155

SEQ ID NO: 159780 - RNA, 1701 nt, Artificial Sequence; identical to SEQ ID NO: 155542
  derived and/or modified sequence opt4 from hemagglutinin__InfluenzaA__AEO01156

SEQ ID NO: 159781 - RNA, 1701 nt, Artificial Sequence; identical to SEQ ID NO: 155189
  derived and/or modified sequence opt4 from hemagglutinin__InfluenzaA__AEO01157

SEQ ID NO: 159782 - RNA, 1701 nt, Artificial Sequence; identical to SEQ ID NO: 155189
  derived and/or modified sequence opt4 from hemagglutinin__InfluenzaA__AEO01158

SEQ ID NO: 159783 - RNA, 1701 nt, Artificial Sequence; identical to SEQ ID NO: 155189
  derived and/or modified sequence opt4 from hemagglutinin__InfluenzaA__AEO01159

SEQ ID NO: 159784 - RNA, 1701 nt, Artificial Sequence
  derived and/or modified sequence opt4 from hemagglutinin__InfluenzaA__AEO01160
augaaggccauccugguggcccugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159785 - RNA, 1701 nt, Artificial Sequence; identical to SEQ ID NO: 155189
  derived and/or modified sequence opt4 from hemagglutinin__InfluenzaA__AEO01161

SEQ ID NO: 159786 - RNA, 1701 nt, Artificial Sequence; identical to SEQ ID NO: 155542
  derived and/or modified sequence opt4 from hemagglutinin__InfluenzaA__AEO01162

SEQ ID NO: 159787 - RNA, 1701 nt, Artificial Sequence; identical to SEQ ID NO: 155542
  derived and/or modified sequence opt4 from hemagglutinin__InfluenzaA__AEO01163

SEQ ID NO: 159788 - RNA, 1701 nt, Artificial Sequence; identical to SEQ ID NO: 155542
  derived and/or modified sequence opt4 from hemagglutinin__InfluenzaA__AEO01164

SEQ ID NO: 159789 - RNA, 1701 nt, Artificial Sequence
  derived and/or modified sequence opt4 from hemagglutinin__InfluenzaA__AEO01165
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaaguucagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159790 - RNA, 1701 nt, Artificial Sequence; identical to SEQ ID NO: 155542
  derived and/or modified sequence opt4 from hemagglutinin__InfluenzaA__AEO01166

SEQ ID NO: 159791 - RNA, 1701 nt, Artificial Sequence
  derived and/or modified sequence opt4 from hemagglutinin__InfluenzaA__AEO01167
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucgccauggagagaaacgccggcagcggcaucaucaucagcgacaccagcgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159792 - RNA, 1701 nt, Artificial Sequence; identical to SEQ ID NO: 155189
  derived and/or modified sequence opt4 from hemagglutinin__InfluenzaA__AEO01168

SEQ ID NO: 159793 - RNA, 1701 nt, Artificial Sequence; identical to SEQ ID NO: 155542
  derived and/or modified sequence opt4 from hemagglutinin__InfluenzaA__AEO01169

SEQ ID NO: 159794 - RNA, 1701 nt, Artificial Sequence; identical to SEQ ID NO: 155542
  derived and/or modified sequence opt4 from hemagglutinin__InfluenzaA__AEO01170

SEQ ID NO: 159795 - RNA, 1701 nt, Artificial Sequence; identical to SEQ ID NO: 155542
  derived and/or modified sequence opt4 from hemagglutinin__InfluenzaA__AEO01171

SEQ ID NO: 159796 - RNA, 1701 nt, Artificial Sequence; identical to SEQ ID NO: 155189
  derived and/or modified sequence opt4 from hemagglutinin__InfluenzaA__AEO01172

SEQ ID NO: 159797 - RNA, 1701 nt, Artificial Sequence
  derived and/or modified sequence opt4 from hemagglutinin__InfluenzaA__AEO01173
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcggcaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159798 - RNA, 1701 nt, Artificial Sequence
  derived and/or modified sequence opt4 from hemagglutinin__InfluenzaA__AEO01174
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcggcaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159799 - RNA, 1701 nt, Artificial Sequence; identical to SEQ ID NO: 155189
  derived and/or modified sequence opt4 from hemagglutinin__InfluenzaA__AEO01176

SEQ ID NO: 159800 - RNA, 1701 nt, Artificial Sequence; identical to SEQ ID NO: 155189
  derived and/or modified sequence opt4 from hemagglutinin__InfluenzaA__AEO01177

SEQ ID NO: 159801 - RNA, 1701 nt, Artificial Sequence; identical to SEQ ID NO: 155542
  derived and/or modified sequence opt4 from hemagglutinin__InfluenzaA__AEO01179

SEQ ID NO: 159802 - RNA, 1701 nt, Artificial Sequence; identical to SEQ ID NO: 155542
  derived and/or modified sequence opt4 from hemagglutinin__InfluenzaA__AEO01180

SEQ ID NO: 159803 - RNA, 1701 nt, Artificial Sequence; identical to SEQ ID NO: 155542
  derived and/or modified sequence opt4 from hemagglutinin__InfluenzaA__AEO01181

SEQ ID NO: 159804 - RNA, 1701 nt, Artificial Sequence; identical to SEQ ID NO: 155542
  derived and/or modified sequence opt4 from hemagglutinin__InfluenzaA__AEO01182

SEQ ID NO: 159805 - RNA, 1701 nt, Artificial Sequence; identical to SEQ ID NO: 155189
  derived and/or modified sequence opt4 from hemagglutinin__InfluenzaA__AEO01183

SEQ ID NO: 159806 - RNA, 1701 nt, Artificial Sequence; identical to SEQ ID NO: 155542
  derived and/or modified sequence opt4 from hemagglutinin__InfluenzaA__AEO01184

SEQ ID NO: 159807 - RNA, 1701 nt, Artificial Sequence; identical to SEQ ID NO: 155189
  derived and/or modified sequence opt4 from hemagglutinin__InfluenzaA__AEO01185

SEQ ID NO: 159808 - RNA, 1701 nt, Artificial Sequence; identical to SEQ ID NO: 155189
  derived and/or modified sequence opt4 from hemagglutinin__InfluenzaA__AEO01186

SEQ ID NO: 159809 - RNA, 1701 nt, Artificial Sequence; identical to SEQ ID NO: 155189
  derived and/or modified sequence opt4 from hemagglutinin__InfluenzaA__AEO01187

SEQ ID NO: 159810 - RNA, 1701 nt, Artificial Sequence; identical to SEQ ID NO: 155189
  derived and/or modified sequence opt4 from hemagglutinin__InfluenzaA__AEO01188

SEQ ID NO: 159811 - RNA, 1701 nt, Artificial Sequence; identical to SEQ ID NO: 155189
  derived and/or modified sequence opt4 from hemagglutinin__InfluenzaA__AEO01189

SEQ ID NO: 159812 - RNA, 1701 nt, Artificial Sequence; identical to SEQ ID NO: 155189
  derived and/or modified sequence opt4 from hemagglutinin__InfluenzaA__AEO01191

SEQ ID NO: 159813 - RNA, 1701 nt, Artificial Sequence; identical to SEQ ID NO: 155189
  derived and/or modified sequence opt4 from hemagglutinin__InfluenzaA__AEO01192

SEQ ID NO: 159814 - RNA, 1701 nt, Artificial Sequence; identical to SEQ ID NO: 156503
  derived and/or modified sequence opt4 from hemagglutinin__InfluenzaA__AEO01193

SEQ ID NO: 159815 - RNA, 1701 nt, Artificial Sequence; identical to SEQ ID NO: 155542
  derived and/or modified sequence opt4 from hemagglutinin__InfluenzaA__AEO01194

SEQ ID NO: 159816 - RNA, 1701 nt, Artificial Sequence; identical to SEQ ID NO: 155542
  derived and/or modified sequence opt4 from hemagglutinin__InfluenzaA__AEO01195

SEQ ID NO: 159817 - RNA, 1701 nt, Artificial Sequence; identical to SEQ ID NO: 155189
  derived and/or modified sequence opt4 from hemagglutinin__InfluenzaA__AEO01196

SEQ ID NO: 159818 - RNA, 1701 nt, Artificial Sequence; identical to SEQ ID NO: 155189
  derived and/or modified sequence opt4 from hemagglutinin__InfluenzaA__AEO01197

SEQ ID NO: 159819 - RNA, 1701 nt, Artificial Sequence; identical to SEQ ID NO: 155542
  derived and/or modified sequence opt4 from hemagglutinin__InfluenzaA__AEO01198

SEQ ID NO: 159820 - RNA, 1701 nt, Artificial Sequence; identical to SEQ ID NO: 156055
  derived and/or modified sequence opt4 from hemagglutinin__InfluenzaA__AEO01200

SEQ ID NO: 159821 - RNA, 1701 nt, Artificial Sequence
  derived and/or modified sequence opt4 from hemagglutinin__InfluenzaA__AEO01201
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggagaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159822 - RNA, 1701 nt, Artificial Sequence; identical to SEQ ID NO: 155189
  derived and/or modified sequence opt4 from hemagglutinin__InfluenzaA__AEO01202

SEQ ID NO: 159823 - RNA, 1701 nt, Artificial Sequence; identical to SEQ ID NO: 156825
  derived and/or modified sequence opt4 from hemagglutinin__InfluenzaA__AEO01203

SEQ ID NO: 159824 - RNA, 1701 nt, Artificial Sequence; identical to SEQ ID NO: 155189
  derived and/or modified sequence opt4 from hemagglutinin__InfluenzaA__AEO01204

SEQ ID NO: 159825 - RNA, 1701 nt, Artificial Sequence; identical to SEQ ID NO: 155189
  derived and/or modified sequence opt4 from hemagglutinin__InfluenzaA__AEO01205

SEQ ID NO: 159826 - RNA, 1701 nt, Artificial Sequence; identical to SEQ ID NO: 155189
  derived and/or modified sequence opt4 from hemagglutinin__InfluenzaA__AEO01206

SEQ ID NO: 159827 - RNA, 1701 nt, Artificial Sequence; identical to SEQ ID NO: 155189
  derived and/or modified sequence opt4 from hemagglutinin__InfluenzaA__AEO01207

SEQ ID NO: 159828 - RNA, 1701 nt, Artificial Sequence; identical to SEQ ID NO: 155189
  derived and/or modified sequence opt4 from hemagglutinin__InfluenzaA__AEO01208

SEQ ID NO: 159829 - RNA, 1701 nt, Artificial Sequence; identical to SEQ ID NO: 155542
  derived and/or modified sequence opt4 from hemagglutinin__InfluenzaA__AEO01209

SEQ ID NO: 159830 - RNA, 1701 nt, Artificial Sequence; identical to SEQ ID NO: 155189
  derived and/or modified sequence opt4 from hemagglutinin__InfluenzaA__AEO01210

SEQ ID NO: 159831 - RNA, 1701 nt, Artificial Sequence; identical to SEQ ID NO: 155542
  derived and/or modified sequence opt4 from hemagglutinin__InfluenzaA__AEO01211

SEQ ID NO: 159832 - RNA, 1701 nt, Artificial Sequence; identical to SEQ ID NO: 155189
  derived and/or modified sequence opt4 from hemagglutinin__InfluenzaA__AEO01212

SEQ ID NO: 159833 - RNA, 1701 nt, Artificial Sequence; identical to SEQ ID NO: 155189
  derived and/or modified sequence opt4 from hemagglutinin__InfluenzaA__AEO01213

SEQ ID NO: 159834 - RNA, 1701 nt, Artificial Sequence
  derived and/or modified sequence opt4 from hemagglutinin__InfluenzaA__AEO01214
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggcccccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159835 - RNA, 1701 nt, Artificial Sequence; identical to SEQ ID NO: 155542
  derived and/or modified sequence opt4 from hemagglutinin__InfluenzaA__AEO01215

SEQ ID NO: 159836 - RNA, 1701 nt, Artificial Sequence
  derived and/or modified sequence opt4 from hemagglutinin__InfluenzaA__AEO01216
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaguggagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159837 - RNA, 1701 nt, Artificial Sequence; identical to SEQ ID NO: 155542
  derived and/or modified sequence opt4 from hemagglutinin__InfluenzaA__AEO01217

SEQ ID NO: 159838 - RNA, 1701 nt, Artificial Sequence; identical to SEQ ID NO: 155542
  derived and/or modified sequence opt4 from hemagglutinin__InfluenzaA__AEO01218

SEQ ID NO: 159839 - RNA, 1701 nt, Artificial Sequence; identical to SEQ ID NO: 155542
  derived and/or modified sequence opt4 from hemagglutinin__InfluenzaA__AEO01219

SEQ ID NO: 159840 - RNA, 1701 nt, Artificial Sequence; identical to SEQ ID NO: 155280
  derived and/or modified sequence opt4 from hemagglutinin__InfluenzaA__AEO01220

SEQ ID NO: 159841 - RNA, 1701 nt, Artificial Sequence; identical to SEQ ID NO: 155189
  derived and/or modified sequence opt4 from hemagglutinin__InfluenzaA__AEO01221

SEQ ID NO: 159842 - RNA, 1701 nt, Artificial Sequence; identical to SEQ ID NO: 155189
  derived and/or modified sequence opt4 from hemagglutinin__InfluenzaA__AEO01222

SEQ ID NO: 159843 - RNA, 1701 nt, Artificial Sequence; identical to SEQ ID NO: 155542
  derived and/or modified sequence opt4 from hemagglutinin__InfluenzaA__AEO01223

SEQ ID NO: 159844 - RNA, 1701 nt, Artificial Sequence
  derived and/or modified sequence opt4 from hemagglutinin__InfluenzaA__AEO01224
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccaccgagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159845 - RNA, 1701 nt, Artificial Sequence
  derived and/or modified sequence opt4 from hemagglutinin__InfluenzaA__AEO01225
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggaccgugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159846 - RNA, 1701 nt, Artificial Sequence
  derived and/or modified sequence opt4 from hemagglutinin__InfluenzaA__AEO01226
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgacggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159847 - RNA, 1701 nt, Artificial Sequence; identical to SEQ ID NO: 157356
  derived and/or modified sequence opt4 from hemagglutinin__InfluenzaA__AEO01227

SEQ ID NO: 159848 - RNA, 1701 nt, Artificial Sequence; identical to SEQ ID NO: 155189
  derived and/or modified sequence opt4 from hemagglutinin__InfluenzaA__AEO01228

SEQ ID NO: 159849 - RNA, 1701 nt, Artificial Sequence; identical to SEQ ID NO: 155189
  derived and/or modified sequence opt4 from hemagglutinin__InfluenzaA__AEO01229

SEQ ID NO: 159850 - RNA, 1701 nt, Artificial Sequence
  derived and/or modified sequence opt4 from hemagglutinin__InfluenzaA__AEO01230
augaaggccauccugguggugcugcuguacaccuucgccaccgccaacgccgacacccugugcaucggcuaccacgccaacaacagcaccgacaccguggacaccgugcuggagagaaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcaaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159851 - RNA, 1701 nt, Artificial Sequence; identical to SEQ ID NO: 155189
  derived and/or modified sequence opt4 from hemagglutinin__InfluenzaA__AEO01231

SEQ ID NO: 159852 - RNA, 1701 nt, Artificial Sequence; identical to SEQ ID NO: 155542
  derived and/or modified sequence opt4 from hemagglutinin__InfluenzaA__AEO01232

SEQ ID NO: 159853 - RNA, 1701 nt, Artificial Sequence; identical to SEQ ID NO: 155189
  derived and/or modified sequence opt4 from hemagglutinin__InfluenzaA__AEO01233

SEQ ID NO: 159854 - RNA, 1701 nt, Artificial Sequence; identical to SEQ ID NO: 155189
  derived and/or modified sequence opt4 from hemagglutinin__InfluenzaA__AEO01234

SEQ ID NO: 159855 - RNA, 1701 nt, Artificial Sequence; identical to SEQ ID NO: 155189
  derived and/or modified sequence opt4 from hemagglutinin__InfluenzaA__AEO01235

SEQ ID NO: 159856 - RNA, 1701 nt, Artificial Sequence; identical to SEQ ID NO: 159061
  derived and/or modified sequence opt4 from hemagglutinin__InfluenzaA__AEO01236

SEQ ID NO: 159857 - RNA, 1701 nt, Artificial Sequence; identical to SEQ ID NO: 155189
  derived and/or modified sequence opt4 from hemagglutinin__InfluenzaA__AEO01237

SEQ ID NO: 159858 - RNA, 1701 nt, Artificial Sequence; identical to SEQ ID NO: 155189
  derived and/or modified sequence opt4 from hemagglutinin__InfluenzaA__AEO01238

SEQ ID NO: 159859 - RNA, 1701 nt, Artificial Sequence; identical to SEQ ID NO: 155189
  derived and/or modified sequence opt4 from hemagglutinin__InfluenzaA__AEO01240

SEQ ID NO: 159860 - RNA, 1701 nt, Artificial Sequence; identical to SEQ ID NO: 155542
  derived and/or modified sequence opt4 from hemagglutinin__InfluenzaA__AEO01241

SEQ ID NO: 159861 - RNA, 1701 nt, Artificial Sequence; identical to SEQ ID NO: 155189
  derived and/or modified sequence opt4 from hemagglutinin__InfluenzaA__AEO01242

SEQ ID NO: 159862 - RNA, 1701 nt, Artificial Sequence
  derived and/or modified sequence opt4 from hemagglutinin__InfluenzaA__AEO01244
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcaaguacagcaagaaguucaagcccgagaucgccaucagacccaaggugagaggccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159863 - RNA, 1701 nt, Artificial Sequence; identical to SEQ ID NO: 155189
  derived and/or modified sequence opt4 from hemagglutinin__InfluenzaA__AEO01245

SEQ ID NO: 159864 - RNA, 1701 nt, Artificial Sequence
  derived and/or modified sequence opt4 from hemagglutinin__InfluenzaA__AEO01247
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcauccugaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagcacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159865 - RNA, 1701 nt, Artificial Sequence; identical to SEQ ID NO: 155189
  derived and/or modified sequence opt4 from hemagglutinin__InfluenzaA__AEO01248

SEQ ID NO: 159866 - RNA, 1701 nt, Artificial Sequence; identical to SEQ ID NO: 155189
  derived and/or modified sequence opt4 from hemagglutinin__InfluenzaA__AEO01249

SEQ ID NO: 159867 - RNA, 1701 nt, Artificial Sequence
  derived and/or modified sequence opt4 from hemagglutinin__InfluenzaA__AEO01250
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgaggacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159868 - RNA, 1701 nt, Artificial Sequence; identical to SEQ ID NO: 156786
  derived and/or modified sequence opt4 from hemagglutinin__InfluenzaA__AEO01251

SEQ ID NO: 159869 - RNA, 1701 nt, Artificial Sequence; identical to SEQ ID NO: 155189
  derived and/or modified sequence opt4 from hemagglutinin__InfluenzaA__AEO01252

SEQ ID NO: 159870 - RNA, 1701 nt, Artificial Sequence; identical to SEQ ID NO: 155189
  derived and/or modified sequence opt4 from hemagglutinin__InfluenzaA__AEO01253

SEQ ID NO: 159871 - RNA, 1701 nt, Artificial Sequence
  derived and/or modified sequence opt4 from hemagglutinin__InfluenzaA__AEO01254
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacaacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159872 - RNA, 1701 nt, Artificial Sequence; identical to SEQ ID NO: 155636
  derived and/or modified sequence opt4 from hemagglutinin__InfluenzaA__AEO01256

SEQ ID NO: 159873 - RNA, 1701 nt, Artificial Sequence; identical to SEQ ID NO: 158608
  derived and/or modified sequence opt4 from hemagglutinin__InfluenzaA__AEO01257

SEQ ID NO: 159874 - RNA, 1701 nt, Artificial Sequence; identical to SEQ ID NO: 155189
  derived and/or modified sequence opt4 from hemagglutinin__InfluenzaA__AEO01258

SEQ ID NO: 159875 - RNA, 1701 nt, Artificial Sequence; identical to SEQ ID NO: 159871
  derived and/or modified sequence opt4 from hemagglutinin__InfluenzaA__AEO01259

SEQ ID NO: 159876 - RNA, 1701 nt, Artificial Sequence; identical to SEQ ID NO: 157744
  derived and/or modified sequence opt4 from hemagglutinin__InfluenzaA__AEO01260

SEQ ID NO: 159877 - RNA, 1701 nt, Artificial Sequence
  derived and/or modified sequence opt4 from hemagglutinin__InfluenzaA__AEO01261
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagaauggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccggcaucuaccagauccuggccaucuacagcaccguggccagcagccuggugcugguggugagccugggcgccaucagcuucuggaugugcagcaacggcagccugcagugcagaaucugcaucuga

SEQ ID NO: 159878 - RNA, 1701 nt, Artificial Sequence; identical to SEQ ID NO: 155189
  derived and/or modified sequence opt4 from hemagglutinin__InfluenzaA__AEO01262

SEQ ID NO: 159879 - RNA, 1701 nt, Artificial Sequence; identical to SEQ ID NO: 156871
  derived and/or modified sequence opt4 from hemagglutinin__InfluenzaA__AEO01263

SEQ ID NO: 159880 - RNA, 1701 nt, Artificial Sequence; identical to SEQ ID NO: 155542
  derived and/or modified sequence opt4 from hemagglutinin__InfluenzaA__AEO01264

SEQ ID NO: 159881 - RNA, 1701 nt, Artificial Sequence; identical to SEQ ID NO: 155189
  derived and/or modified sequence opt4 from hemagglutinin__InfluenzaA__AEO01265

SEQ ID NO: 159882 - RNA, 1701 nt, Artificial Sequence
  derived and/or modified sequence opt4 from hemagglutinin__InfluenzaA__AEO01266
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagaggccaggagggcagaaugaacuacuacuggacccugguggagcccggcgacaagaucaccuucgaggccaccggcaaccugguggugcccagauacgccuucgccauggagagaaacgccggcagcggcaucaucaucagcgacgcccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159883 - RNA, 1701 nt, Artificial Sequence; identical to SEQ ID NO: 155189
  derived and/or modified sequence opt4 from hemagglutinin__InfluenzaA__AEO01267

SEQ ID NO: 159884 - RNA, 1701 nt, Artificial Sequence; identical to SEQ ID NO: 155189
  derived and/or modified sequence opt4 from hemagglutinin__InfluenzaA__AEO01268

SEQ ID NO: 159885 - RNA, 1701 nt, Artificial Sequence
  derived and/or modified sequence opt4 from hemagglutinin__InfluenzaA__AEO01269
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucgccauggagagaaacgccggcagcggcaucgugaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaauggagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159886 - RNA, 1701 nt, Artificial Sequence; identical to SEQ ID NO: 156353
  derived and/or modified sequence opt4 from hemagglutinin__InfluenzaA__AEO01270

SEQ ID NO: 159887 - RNA, 1701 nt, Artificial Sequence
  derived and/or modified sequence opt4 from hemagglutinin__InfluenzaA__AEO01271
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcgacaucgccggcuggauccugggcaaccccgagugcgagagccugagcaccgccagcagcuggagcuacaucguggagacccccagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagcacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159888 - RNA, 1701 nt, Artificial Sequence; identical to SEQ ID NO: 155189
  derived and/or modified sequence opt4 from hemagglutinin__InfluenzaA__AEO01272

SEQ ID NO: 159889 - RNA, 1701 nt, Artificial Sequence; identical to SEQ ID NO: 155189
  derived and/or modified sequence opt4 from hemagglutinin__InfluenzaA__AEO01273

SEQ ID NO: 159890 - RNA, 1701 nt, Artificial Sequence; identical to SEQ ID NO: 155189
  derived and/or modified sequence opt4 from hemagglutinin__InfluenzaA__AEO01274

SEQ ID NO: 159891 - RNA, 1701 nt, Artificial Sequence; identical to SEQ ID NO: 157357
  derived and/or modified sequence opt4 from hemagglutinin__InfluenzaA__AEO01275

SEQ ID NO: 159892 - RNA, 1701 nt, Artificial Sequence
  derived and/or modified sequence opt4 from hemagglutinin__InfluenzaA__AEO01276
augaaggccauccugguggugcugcuguacaccuucgccaccgccaacgccgacacccugugcaucggcuaccacgccaacaacagcaccgacaccguggacaccgugcugaagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccgaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159893 - RNA, 1701 nt, Artificial Sequence; identical to SEQ ID NO: 155189
  derived and/or modified sequence opt4 from hemagglutinin__InfluenzaA__AEO01277

SEQ ID NO: 159894 - RNA, 1701 nt, Artificial Sequence
  derived and/or modified sequence opt4 from hemagglutinin__InfluenzaA__AEO01278
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcgacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagcacgccaucgacgagaucaccaacaaggugaacagcgugaucgagaagaugaacacccaguucaccgccgugggcaaggaguucaaccaccuggagaagagaaucgccaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159895 - RNA, 1701 nt, Artificial Sequence
  derived and/or modified sequence opt4 from hemagglutinin__InfluenzaA__AEO01279
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaccgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159896 - RNA, 1701 nt, Artificial Sequence
  derived and/or modified sequence opt4 from hemagglutinin__InfluenzaA__AEO01282
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaagcuguacgagaaggugagaagccagcugaagaacaacgccaaggagaucggcaacggcugcuucgaguucuaccacaagugcaacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159897 - RNA, 1701 nt, Artificial Sequence; identical to SEQ ID NO: 156291
  derived and/or modified sequence opt4 from hemagglutinin__InfluenzaA__AEO01283

SEQ ID NO: 159898 - RNA, 1701 nt, Artificial Sequence
  derived and/or modified sequence opt4 from hemagglutinin__InfluenzaA__AEO01284
augaaggccauccugguggugcugcuguacaccuucgccaucgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagcacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucaacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159899 - RNA, 1701 nt, Artificial Sequence; identical to SEQ ID NO: 156290
  derived and/or modified sequence opt4 from hemagglutinin__InfluenzaA__AEO01285

SEQ ID NO: 159900 - RNA, 1701 nt, Artificial Sequence; identical to SEQ ID NO: 156383
  derived and/or modified sequence opt4 from hemagglutinin__InfluenzaA__AEO01286

SEQ ID NO: 159901 - RNA, 1701 nt, Artificial Sequence
  derived and/or modified sequence opt4 from hemagglutinin__InfluenzaA__AEO01287
augaaggccauccugguggugcugcuguacaccuucgccaccgccaacagcgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159902 - RNA, 1701 nt, Artificial Sequence; identical to SEQ ID NO: 155542
  derived and/or modified sequence opt4 from hemagglutinin__InfluenzaA__AEO01288

SEQ ID NO: 159903 - RNA, 1701 nt, Artificial Sequence; identical to SEQ ID NO: 155189
  derived and/or modified sequence opt4 from hemagglutinin__InfluenzaA__AEO01289

SEQ ID NO: 159904 - RNA, 1701 nt, Artificial Sequence
  derived and/or modified sequence opt4 from hemagglutinin__InfluenzaA__AEO01290
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugagcuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159905 - RNA, 1701 nt, Artificial Sequence; identical to SEQ ID NO: 155189
  derived and/or modified sequence opt4 from hemagglutinin__InfluenzaA__AEO01291

SEQ ID NO: 159906 - RNA, 1701 nt, Artificial Sequence; identical to SEQ ID NO: 155189
  derived and/or modified sequence opt4 from hemagglutinin__InfluenzaA__AEO01292

SEQ ID NO: 159907 - RNA, 1701 nt, Artificial Sequence
  derived and/or modified sequence opt4 from hemagglutinin__InfluenzaA__AEO01294
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcgacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagcacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159908 - RNA, 1701 nt, Artificial Sequence
  derived and/or modified sequence opt4 from hemagglutinin__InfluenzaA__AEO01295
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcaacagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacuacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159909 - RNA, 1701 nt, Artificial Sequence; identical to SEQ ID NO: 155189
  derived and/or modified sequence opt4 from hemagglutinin__InfluenzaA__AEO01296

SEQ ID NO: 159910 - RNA, 1701 nt, Artificial Sequence; identical to SEQ ID NO: 156871
  derived and/or modified sequence opt4 from hemagglutinin__InfluenzaA__AEO01297

SEQ ID NO: 159911 - RNA, 1701 nt, Artificial Sequence; identical to SEQ ID NO: 156876
  derived and/or modified sequence opt4 from hemagglutinin__InfluenzaA__AEO01298

SEQ ID NO: 159912 - RNA, 1701 nt, Artificial Sequence; identical to SEQ ID NO: 155189
  derived and/or modified sequence opt4 from hemagglutinin__InfluenzaA__AEO01299

SEQ ID NO: 159913 - RNA, 1701 nt, Artificial Sequence; identical to SEQ ID NO: 155189
  derived and/or modified sequence opt4 from hemagglutinin__InfluenzaA__AEO01300

SEQ ID NO: 159914 - RNA, 1701 nt, Artificial Sequence; identical to SEQ ID NO: 155189
  derived and/or modified sequence opt4 from hemagglutinin__InfluenzaA__AEO01301

SEQ ID NO: 159915 - RNA, 1701 nt, Artificial Sequence; identical to SEQ ID NO: 155189
  derived and/or modified sequence opt4 from hemagglutinin__InfluenzaA__AEO01302

SEQ ID NO: 159916 - RNA, 1701 nt, Artificial Sequence; identical to SEQ ID NO: 156786
  derived and/or modified sequence opt4 from hemagglutinin__InfluenzaA__AEO01303

SEQ ID NO: 159917 - RNA, 1701 nt, Artificial Sequence
  derived and/or modified sequence opt4 from hemagglutinin__InfluenzaA__AEO01304
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaaggccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaagggcgugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159918 - RNA, 1701 nt, Artificial Sequence
  derived and/or modified sequence opt4 from hemagglutinin__InfluenzaA__AEO01305
augaaggccauccugguggugcugcuguacaccuucgccaccgccagcgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159919 - RNA, 1701 nt, Artificial Sequence; identical to SEQ ID NO: 155189
  derived and/or modified sequence opt4 from hemagglutinin__InfluenzaA__AEO01306

SEQ ID NO: 159920 - RNA, 1701 nt, Artificial Sequence; identical to SEQ ID NO: 155189
  derived and/or modified sequence opt4 from hemagglutinin__InfluenzaA__AEO01307

SEQ ID NO: 159921 - RNA, 1701 nt, Artificial Sequence; identical to SEQ ID NO: 155189
  derived and/or modified sequence opt4 from hemagglutinin__InfluenzaA__AEO01308

SEQ ID NO: 159922 - RNA, 1701 nt, Artificial Sequence
  derived and/or modified sequence opt4 from hemagglutinin__InfluenzaA__AEO01309
augaaggccauccugguggugcugcuguacaccuucgccaucgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagcacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcaaggaggccaagcugaacagagaggagaucaacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159923 - RNA, 1701 nt, Artificial Sequence
  derived and/or modified sequence opt4 from hemagglutinin__InfluenzaA__AEO01310
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacagaggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159924 - RNA, 1701 nt, Artificial Sequence; identical to SEQ ID NO: 155189
  derived and/or modified sequence opt4 from hemagglutinin__InfluenzaA__AEO01311

SEQ ID NO: 159925 - RNA, 1701 nt, Artificial Sequence
  derived and/or modified sequence opt4 from hemagglutinin__InfluenzaA__AEO01312
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaucguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159926 - RNA, 1701 nt, Artificial Sequence; identical to SEQ ID NO: 155542
  derived and/or modified sequence opt4 from hemagglutinin__InfluenzaA__AEO01313

SEQ ID NO: 159927 - RNA, 1701 nt, Artificial Sequence; identical to SEQ ID NO: 156353
  derived and/or modified sequence opt4 from hemagglutinin__InfluenzaA__AEO01314

SEQ ID NO: 159928 - RNA, 1701 nt, Artificial Sequence
  derived and/or modified sequence opt4 from hemagglutinin__InfluenzaA__AEO01315
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacagaaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159929 - RNA, 1701 nt, Artificial Sequence; identical to SEQ ID NO: 155189
  derived and/or modified sequence opt4 from hemagglutinin__InfluenzaA__AEO01316

SEQ ID NO: 159930 - RNA, 1701 nt, Artificial Sequence; identical to SEQ ID NO: 155189
  derived and/or modified sequence opt4 from hemagglutinin__InfluenzaA__AEO01317

SEQ ID NO: 159931 - RNA, 1701 nt, Artificial Sequence; identical to SEQ ID NO: 155189
  derived and/or modified sequence opt4 from hemagglutinin__InfluenzaA__AEO01318

SEQ ID NO: 159932 - RNA, 1701 nt, Artificial Sequence; identical to SEQ ID NO: 155189
  derived and/or modified sequence opt4 from hemagglutinin__InfluenzaA__AEO01319

SEQ ID NO: 159933 - RNA, 1701 nt, Artificial Sequence
  derived and/or modified sequence opt4 from hemagglutinin__InfluenzaA__AEO01321
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggcccugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159934 - RNA, 1701 nt, Artificial Sequence; identical to SEQ ID NO: 155189
  derived and/or modified sequence opt4 from hemagglutinin__InfluenzaA__AEO01322

SEQ ID NO: 159935 - RNA, 1701 nt, Artificial Sequence; identical to SEQ ID NO: 156871
  derived and/or modified sequence opt4 from hemagglutinin__InfluenzaA__AEO01323

SEQ ID NO: 159936 - RNA, 1701 nt, Artificial Sequence; identical to SEQ ID NO: 156786
  derived and/or modified sequence opt4 from hemagglutinin__InfluenzaA__AEO01324

SEQ ID NO: 159937 - RNA, 1701 nt, Artificial Sequence; identical to SEQ ID NO: 155189
  derived and/or modified sequence opt4 from hemagglutinin__InfluenzaA__AEO01325

SEQ ID NO: 159938 - RNA, 1701 nt, Artificial Sequence
  derived and/or modified sequence opt4 from hemagglutinin__InfluenzaA__AEO01326
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccaggacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159939 - RNA, 1701 nt, Artificial Sequence; identical to SEQ ID NO: 155189
  derived and/or modified sequence opt4 from hemagglutinin__InfluenzaA__AEO01327

SEQ ID NO: 159940 - RNA, 1701 nt, Artificial Sequence; identical to SEQ ID NO: 159898
  derived and/or modified sequence opt4 from hemagglutinin__InfluenzaA__AEO01328

SEQ ID NO: 159941 - RNA, 1701 nt, Artificial Sequence; identical to SEQ ID NO: 155189
  derived and/or modified sequence opt4 from hemagglutinin__InfluenzaA__AEO01330

SEQ ID NO: 159942 - RNA, 1701 nt, Artificial Sequence
  derived and/or modified sequence opt4 from hemagglutinin__InfluenzaA__AEO01331
augaaggccauccugguggugcugcuguacaccuucgccaccgccaacgccgacacccugugcaucggcuaccacgccaacaacagcaccgacaccguggacacccugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159943 - RNA, 1701 nt, Artificial Sequence
  derived and/or modified sequence opt4 from hemagglutinin__InfluenzaA__AEO01332
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggccugagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucgccauggagagaaacgccggcagcggcaucgugaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaauggagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaccaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159944 - RNA, 1701 nt, Artificial Sequence; identical to SEQ ID NO: 157357
  derived and/or modified sequence opt4 from hemagglutinin__InfluenzaA__AEO01333

SEQ ID NO: 159945 - RNA, 1701 nt, Artificial Sequence
  derived and/or modified sequence opt4 from hemagglutinin__InfluenzaA__AEO01334
augaaggccauccugguggugcugcuguacaccuucgccaccgccaacgccgacacccugugcaucggcuaccacgccaacaacagcaccgacaccguggacaccauccuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159946 - RNA, 1701 nt, Artificial Sequence; identical to SEQ ID NO: 156786
  derived and/or modified sequence opt4 from hemagglutinin__InfluenzaA__AEO01335

SEQ ID NO: 159947 - RNA, 1701 nt, Artificial Sequence
  derived and/or modified sequence opt4 from hemagglutinin__InfluenzaA__AEO01336
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugaacaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcgagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159948 - RNA, 1701 nt, Artificial Sequence
  derived and/or modified sequence opt4 from hemagglutinin__InfluenzaA__AEO01337
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuaccacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagcacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159949 - RNA, 1701 nt, Artificial Sequence; identical to SEQ ID NO: 155189
  derived and/or modified sequence opt4 from hemagglutinin__InfluenzaA__AEO01338

SEQ ID NO: 159950 - RNA, 1701 nt, Artificial Sequence; identical to SEQ ID NO: 159061
  derived and/or modified sequence opt4 from hemagglutinin__InfluenzaA__AEO01339

SEQ ID NO: 159951 - RNA, 1701 nt, Artificial Sequence; identical to SEQ ID NO: 159907
  derived and/or modified sequence opt4 from hemagglutinin__InfluenzaA__AEO01340

SEQ ID NO: 159952 - RNA, 1701 nt, Artificial Sequence; identical to SEQ ID NO: 159907
  derived and/or modified sequence opt4 from hemagglutinin__InfluenzaA__AEO01341

SEQ ID NO: 159953 - RNA, 1701 nt, Artificial Sequence; identical to SEQ ID NO: 155189
  derived and/or modified sequence opt4 from hemagglutinin__InfluenzaA__AEO01342

SEQ ID NO: 159954 - RNA, 1701 nt, Artificial Sequence
  derived and/or modified sequence opt4 from hemagglutinin__InfluenzaA__AEO01343
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcaacagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159955 - RNA, 1701 nt, Artificial Sequence
  derived and/or modified sequence opt4 from hemagglutinin__InfluenzaA__AEO01344
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcaaguacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159956 - RNA, 1701 nt, Artificial Sequence; identical to SEQ ID NO: 159061
  derived and/or modified sequence opt4 from hemagglutinin__InfluenzaA__AEO01345

SEQ ID NO: 159957 - RNA, 1701 nt, Artificial Sequence; identical to SEQ ID NO: 155189
  derived and/or modified sequence opt4 from hemagglutinin__InfluenzaA__AEO01346

SEQ ID NO: 159958 - RNA, 1701 nt, Artificial Sequence
  derived and/or modified sequence opt4 from hemagglutinin__InfluenzaA__AEO01347
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcgagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159959 - RNA, 1701 nt, Artificial Sequence
  derived and/or modified sequence opt4 from hemagglutinin__InfluenzaA__AEO01348
augaaggccauccugguggugcugcuguacaccuucgccaucgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159960 - RNA, 1701 nt, Artificial Sequence
  derived and/or modified sequence opt4 from hemagglutinin__InfluenzaA__AEO01349
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgagaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcaaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159961 - RNA, 1701 nt, Artificial Sequence
  derived and/or modified sequence opt4 from hemagglutinin__InfluenzaA__AEO01350
augaaggccauccugguggugcugcuguacaccuucgccaccaccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagcacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159962 - RNA, 1701 nt, Artificial Sequence; identical to SEQ ID NO: 155189
  derived and/or modified sequence opt4 from hemagglutinin__InfluenzaA__AEO01351

SEQ ID NO: 159963 - RNA, 1701 nt, Artificial Sequence; identical to SEQ ID NO: 156353
  derived and/or modified sequence opt4 from hemagglutinin__InfluenzaA__AEO01352

SEQ ID NO: 159964 - RNA, 1701 nt, Artificial Sequence
  derived and/or modified sequence opt4 from hemagglutinin__InfluenzaA__AEO01353
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcuggugguguuccugggcgccaucagcuucuggaugugcagcaacggcagccugcagugcagaaucugcaucuga

SEQ ID NO: 159965 - RNA, 1701 nt, Artificial Sequence
  derived and/or modified sequence opt4 from hemagglutinin__InfluenzaA__AEO01354
augaaggccauccugguggugcugcuguacaaguucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159966 - RNA, 1701 nt, Artificial Sequence; identical to SEQ ID NO: 156609
  derived and/or modified sequence opt4 from hemagglutinin__InfluenzaA__AEO01355

SEQ ID NO: 159967 - RNA, 1701 nt, Artificial Sequence; identical to SEQ ID NO: 155189
  derived and/or modified sequence opt4 from hemagglutinin__InfluenzaA__AEO01356

SEQ ID NO: 159968 - RNA, 1701 nt, Artificial Sequence
  derived and/or modified sequence opt4 from hemagglutinin__InfluenzaA__AEO01358
augaaggccauccugguggugcugcuguacaccuucgccaccgccaacgccgacacccugugcgugggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgcccacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159969 - RNA, 1701 nt, Artificial Sequence; identical to SEQ ID NO: 156609
  derived and/or modified sequence opt4 from hemagglutinin__InfluenzaA__AEO01359

SEQ ID NO: 159970 - RNA, 1701 nt, Artificial Sequence; identical to SEQ ID NO: 159942
  derived and/or modified sequence opt4 from hemagglutinin__InfluenzaA__AEO01360

SEQ ID NO: 159971 - RNA, 1701 nt, Artificial Sequence; identical to SEQ ID NO: 155542
  derived and/or modified sequence opt4 from hemagglutinin__InfluenzaA__AEO01361

SEQ ID NO: 159972 - RNA, 1701 nt, Artificial Sequence; identical to SEQ ID NO: 159942
  derived and/or modified sequence opt4 from hemagglutinin__InfluenzaA__AEO01362

SEQ ID NO: 159973 - RNA, 1701 nt, Artificial Sequence; identical to SEQ ID NO: 156353
  derived and/or modified sequence opt4 from hemagglutinin__InfluenzaA__AEO01363

SEQ ID NO: 159974 - RNA, 1701 nt, Artificial Sequence
  derived and/or modified sequence opt4 from hemagglutinin__InfluenzaA__AEO01365
augaaggccauccugguggugcugcuguacaccuucgccaccgccaacgccgacacccugugcaucggcuaccacgccaacaacagcaccgacaccguggacaccgugcugaagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaagcgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159975 - RNA, 1701 nt, Artificial Sequence
  derived and/or modified sequence opt4 from hemagglutinin__InfluenzaA__AEO01366
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcagcaccaccugccagacccccaagggcgccaucaacaccagccugcccuuccagaacgugcaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159976 - RNA, 1701 nt, Artificial Sequence; identical to SEQ ID NO: 159947
  derived and/or modified sequence opt4 from hemagglutinin__InfluenzaA__AEO01367

SEQ ID NO: 159977 - RNA, 1701 nt, Artificial Sequence
  derived and/or modified sequence opt4 from hemagglutinin__InfluenzaA__AEO01368
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaacaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159978 - RNA, 1701 nt, Artificial Sequence; identical to SEQ ID NO: 155189
  derived and/or modified sequence opt4 from hemagglutinin__InfluenzaA__AEO01369

SEQ ID NO: 159979 - RNA, 1701 nt, Artificial Sequence; identical to SEQ ID NO: 159907
  derived and/or modified sequence opt4 from hemagglutinin__InfluenzaA__AEO01370

SEQ ID NO: 159980 - RNA, 1701 nt, Artificial Sequence; identical to SEQ ID NO: 159954
  derived and/or modified sequence opt4 from hemagglutinin__InfluenzaA__AEO01371

SEQ ID NO: 159981 - RNA, 1701 nt, Artificial Sequence; identical to SEQ ID NO: 156786
  derived and/or modified sequence opt4 from hemagglutinin__InfluenzaA__AEO01372

SEQ ID NO: 159982 - RNA, 1701 nt, Artificial Sequence; identical to SEQ ID NO: 156786
  derived and/or modified sequence opt4 from hemagglutinin__InfluenzaA__AEO01373

SEQ ID NO: 159983 - RNA, 1701 nt, Artificial Sequence
  derived and/or modified sequence opt4 from hemagglutinin__InfluenzaA__AEO01374
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcgacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacaucaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagcacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159984 - RNA, 1701 nt, Artificial Sequence; identical to SEQ ID NO: 159958
  derived and/or modified sequence opt4 from hemagglutinin__InfluenzaA__AEO01375

SEQ ID NO: 159985 - RNA, 1701 nt, Artificial Sequence; identical to SEQ ID NO: 155189
  derived and/or modified sequence opt4 from hemagglutinin__InfluenzaA__AEO01376

SEQ ID NO: 159986 - RNA, 1701 nt, Artificial Sequence; identical to SEQ ID NO: 157357
  derived and/or modified sequence opt4 from hemagglutinin__InfluenzaA__AEO01377

SEQ ID NO: 159987 - RNA, 1701 nt, Artificial Sequence
  derived and/or modified sequence opt4 from hemagglutinin__InfluenzaA__AEO01378
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagacccccagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159988 - RNA, 1701 nt, Artificial Sequence; identical to SEQ ID NO: 156353
  derived and/or modified sequence opt4 from hemagglutinin__InfluenzaA__AEO01379

SEQ ID NO: 159989 - RNA, 1701 nt, Artificial Sequence; identical to SEQ ID NO: 159958
  derived and/or modified sequence opt4 from hemagglutinin__InfluenzaA__AEO01380

SEQ ID NO: 159990 - RNA, 1701 nt, Artificial Sequence; identical to SEQ ID NO: 159958
  derived and/or modified sequence opt4 from hemagglutinin__InfluenzaA__AEO01381

SEQ ID NO: 159991 - RNA, 1701 nt, Artificial Sequence; identical to SEQ ID NO: 156353
  derived and/or modified sequence opt4 from hemagglutinin__InfluenzaA__AEO01382

SEQ ID NO: 159992 - RNA, 1701 nt, Artificial Sequence; identical to SEQ ID NO: 156786
  derived and/or modified sequence opt4 from hemagglutinin__InfluenzaA__AEO01383

SEQ ID NO: 159993 - RNA, 1701 nt, Artificial Sequence
  derived and/or modified sequence opt4 from hemagglutinin__InfluenzaA__AEO01384
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcgugagcccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159994 - RNA, 1701 nt, Artificial Sequence
  derived and/or modified sequence opt4 from hemagglutinin__InfluenzaA__AEO01385
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccaacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159995 - RNA, 1701 nt, Artificial Sequence; identical to SEQ ID NO: 159898
  derived and/or modified sequence opt4 from hemagglutinin__InfluenzaA__AEO01386

SEQ ID NO: 159996 - RNA, 1701 nt, Artificial Sequence
  derived and/or modified sequence opt4 from hemagglutinin__InfluenzaA__AEO01387
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacauccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159997 - RNA, 1701 nt, Artificial Sequence
  derived and/or modified sequence opt4 from hemagglutinin__InfluenzaA__AEO01388
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagaaguucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaccaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159998 - RNA, 1701 nt, Artificial Sequence
  derived and/or modified sequence opt4 from hemagglutinin__InfluenzaA__AEO01389
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcaccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 159999 - RNA, 1701 nt, Artificial Sequence
  derived and/or modified sequence opt4 from hemagglutinin__InfluenzaA__AEO01390
augaaggccauccugguggugcugcuguacaccuucgccaucgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucguggagaccagcagauacagcaagaaggugaagcccgagaucgccaucagacccagagugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagcacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgagguggccaagcugaacagagaggagaucaacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160000 - RNA, 1701 nt, Artificial Sequence; identical to SEQ ID NO: 159898
  derived and/or modified sequence opt4 from hemagglutinin__InfluenzaA__AEO01391

SEQ ID NO: 160001 - RNA, 1701 nt, Artificial Sequence; identical to SEQ ID NO: 159907
  derived and/or modified sequence opt4 from hemagglutinin__InfluenzaA__AEO01392

SEQ ID NO: 160002 - RNA, 1701 nt, Artificial Sequence; identical to SEQ ID NO: 156786
  derived and/or modified sequence opt4 from hemagglutinin__InfluenzaA__AEO01393

SEQ ID NO: 160003 - RNA, 1701 nt, Artificial Sequence; identical to SEQ ID NO: 156290
  derived and/or modified sequence opt4 from hemagglutinin__InfluenzaA__AEO01394

SEQ ID NO: 160004 - RNA, 1701 nt, Artificial Sequence
  derived and/or modified sequence opt4 from hemagglutinin__InfluenzaA__AEO01395
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuuccuggacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160005 - RNA, 1701 nt, Artificial Sequence; identical to SEQ ID NO: 156290
  derived and/or modified sequence opt4 from hemagglutinin__InfluenzaA__AEO01396

SEQ ID NO: 160006 - RNA, 1701 nt, Artificial Sequence
  derived and/or modified sequence opt4 from hemagglutinin__InfluenzaA__AEO01397
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacaccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160007 - RNA, 1701 nt, Artificial Sequence
  derived and/or modified sequence opt4 from hemagglutinin__InfluenzaA__AEO01398
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccaacguguucgugggcaccagcagauacagcaagaaguucaagcccgagaucgccaucagacccaaggugagaggccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160008 - RNA, 1701 nt, Artificial Sequence; identical to SEQ ID NO: 159907
  derived and/or modified sequence opt4 from hemagglutinin__InfluenzaA__AEO01399

SEQ ID NO: 160009 - RNA, 1701 nt, Artificial Sequence; identical to SEQ ID NO: 155189
  derived and/or modified sequence opt4 from hemagglutinin__InfluenzaA__AEO01402

SEQ ID NO: 160010 - RNA, 1701 nt, Artificial Sequence; identical to SEQ ID NO: 156353
  derived and/or modified sequence opt4 from hemagglutinin__InfluenzaA__AEO01403

SEQ ID NO: 160011 - RNA, 1701 nt, Artificial Sequence; identical to SEQ ID NO: 155189
  derived and/or modified sequence opt4 from hemagglutinin__InfluenzaA__AEO01404

SEQ ID NO: 160012 - RNA, 1701 nt, Artificial Sequence
  derived and/or modified sequence opt4 from hemagglutinin__InfluenzaA__AEO01405
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccaugaucuaccagauccuggccaucuacagcaccguggccagcagccuggugcugguggugagccugggcgccaucagcuucuggaugugcagcaacggcagccugcagugcagaaucugcaucuga

SEQ ID NO: 160013 - RNA, 1701 nt, Artificial Sequence
  derived and/or modified sequence opt4 from hemagglutinin__InfluenzaA__AEO01407
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagcacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucaacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160014 - RNA, 1701 nt, Artificial Sequence
  derived and/or modified sequence opt4 from hemagglutinin__InfluenzaA__AEO01408
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagaucgacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160015 - RNA, 1701 nt, Artificial Sequence; identical to SEQ ID NO: 156291
  derived and/or modified sequence opt4 from hemagglutinin__InfluenzaA__AEO01409

SEQ ID NO: 160016 - RNA, 1701 nt, Artificial Sequence; identical to SEQ ID NO: 159907
  derived and/or modified sequence opt4 from hemagglutinin__InfluenzaA__AEO01410

SEQ ID NO: 160017 - RNA, 1701 nt, Artificial Sequence; identical to SEQ ID NO: 158608
  derived and/or modified sequence opt4 from hemagglutinin__InfluenzaA__AEO01411

SEQ ID NO: 160018 - RNA, 1701 nt, Artificial Sequence; identical to SEQ ID NO: 155542
  derived and/or modified sequence opt4 from hemagglutinin__InfluenzaA__AEO01412

SEQ ID NO: 160019 - RNA, 1701 nt, Artificial Sequence
  derived and/or modified sequence opt4 from hemagglutinin__InfluenzaA__AEO01413
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagagcaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160020 - RNA, 1701 nt, Artificial Sequence
  derived and/or modified sequence opt4 from hemagglutinin__InfluenzaA__AEO01414
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacaccggcagcggcaucaucaucagcgacacccccgugcacgacugcagcaccaccugccagacccccaagggcgccaucaacaccagccugcccuuccagaacgugcaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160021 - RNA, 1701 nt, Artificial Sequence; identical to SEQ ID NO: 158820
  derived and/or modified sequence opt4 from hemagglutinin__InfluenzaA__AEO01416

SEQ ID NO: 160022 - RNA, 1701 nt, Artificial Sequence; identical to SEQ ID NO: 156353
  derived and/or modified sequence opt4 from hemagglutinin__InfluenzaA__AEO01418

SEQ ID NO: 160023 - RNA, 1701 nt, Artificial Sequence; identical to SEQ ID NO: 156353
  derived and/or modified sequence opt4 from hemagglutinin__InfluenzaA__AEO01419

SEQ ID NO: 160024 - RNA, 1701 nt, Artificial Sequence
  derived and/or modified sequence opt4 from hemagglutinin__InfluenzaA__AEO01420
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaguacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcaacagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160025 - RNA, 1701 nt, Artificial Sequence
  derived and/or modified sequence opt4 from hemagglutinin__InfluenzaA__AEO01421
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagaaguucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160026 - RNA, 1701 nt, Artificial Sequence
  derived and/or modified sequence opt4 from hemagglutinin__InfluenzaA__AEO01422
augaaggccauccugguggugcugcuguacaccuucgccaucgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaaccuguaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagcacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucaacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160027 - RNA, 1701 nt, Artificial Sequence
  derived and/or modified sequence opt4 from hemagglutinin__InfluenzaA__AEO01423
augaaggccauccugaucgugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucaccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160028 - RNA, 1701 nt, Artificial Sequence; identical to SEQ ID NO: 160025
  derived and/or modified sequence opt4 from hemagglutinin__InfluenzaA__AEO01424

SEQ ID NO: 160029 - RNA, 1701 nt, Artificial Sequence; identical to SEQ ID NO: 160025
  derived and/or modified sequence opt4 from hemagglutinin__InfluenzaA__AEO01425

SEQ ID NO: 160030 - RNA, 1701 nt, Artificial Sequence; identical to SEQ ID NO: 155189
  derived and/or modified sequence opt4 from hemagglutinin__InfluenzaA__AEO01426

SEQ ID NO: 160031 - RNA, 1701 nt, Artificial Sequence
  derived and/or modified sequence opt4 from hemagglutinin__InfluenzaA__AEO01427
augaaggccauccugguggugcugcuguacaccuucgccaccgccaacagcgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160032 - RNA, 1701 nt, Artificial Sequence
  derived and/or modified sequence opt4 from hemagglutinin__InfluenzaA__AEO01428
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccgaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagaauggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160033 - RNA, 1701 nt, Artificial Sequence; identical to SEQ ID NO: 156353
  derived and/or modified sequence opt4 from hemagglutinin__InfluenzaA__AEO01429

SEQ ID NO: 160034 - RNA, 1701 nt, Artificial Sequence
  derived and/or modified sequence opt4 from hemagglutinin__InfluenzaA__AEO01430
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgacggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160035 - RNA, 1701 nt, Artificial Sequence; identical to SEQ ID NO: 159907
  derived and/or modified sequence opt4 from hemagglutinin__InfluenzaA__AEO01431

SEQ ID NO: 160036 - RNA, 1701 nt, Artificial Sequence; identical to SEQ ID NO: 155189
  derived and/or modified sequence opt4 from hemagglutinin__InfluenzaA__AEO01432

SEQ ID NO: 160037 - RNA, 1701 nt, Artificial Sequence
  derived and/or modified sequence opt4 from hemagglutinin__InfluenzaA__AEO01434
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcgagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugaacaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcgagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160038 - RNA, 1701 nt, Artificial Sequence
  derived and/or modified sequence opt4 from hemagglutinin__InfluenzaA__AEO01435
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccguguacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160039 - RNA, 1701 nt, Artificial Sequence; identical to SEQ ID NO: 160025
  derived and/or modified sequence opt4 from hemagglutinin__InfluenzaA__AEO01436

SEQ ID NO: 160040 - RNA, 1701 nt, Artificial Sequence; identical to SEQ ID NO: 159907
  derived and/or modified sequence opt4 from hemagglutinin__InfluenzaA__AEO01437

SEQ ID NO: 160041 - RNA, 1701 nt, Artificial Sequence; identical to SEQ ID NO: 159958
  derived and/or modified sequence opt4 from hemagglutinin__InfluenzaA__AEO01438

SEQ ID NO: 160042 - RNA, 1701 nt, Artificial Sequence; identical to SEQ ID NO: 155542
  derived and/or modified sequence opt4 from hemagglutinin__InfluenzaA__AEO01440

SEQ ID NO: 160043 - RNA, 1701 nt, Artificial Sequence
  derived and/or modified sequence opt4 from hemagglutinin__InfluenzaA__AEO01441
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgacggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160044 - RNA, 1701 nt, Artificial Sequence; identical to SEQ ID NO: 156609
  derived and/or modified sequence opt4 from hemagglutinin__InfluenzaA__AEO01442

SEQ ID NO: 160045 - RNA, 1701 nt, Artificial Sequence
  derived and/or modified sequence opt4 from hemagglutinin__InfluenzaA__AEO01443
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaaggagaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160046 - RNA, 1701 nt, Artificial Sequence
  derived and/or modified sequence opt4 from hemagglutinin__InfluenzaA__AEO01444
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcaacagcgacaacggcaccugcuaccccggcgacuucaucgacuacgaggagcugagagagcagcugagcagcgugagcagcuucgagagauucgagaucuuccccaagaccagcagcuggcccaaccacgacagcgacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160047 - RNA, 1701 nt, Artificial Sequence; identical to SEQ ID NO: 157357
  derived and/or modified sequence opt4 from hemagglutinin__InfluenzaA__AEO01445

SEQ ID NO: 160048 - RNA, 1701 nt, Artificial Sequence; identical to SEQ ID NO: 159907
  derived and/or modified sequence opt4 from hemagglutinin__InfluenzaA__AEO01446

SEQ ID NO: 160049 - RNA, 1701 nt, Artificial Sequence
  derived and/or modified sequence opt4 from hemagglutinin__InfluenzaA__AEO01447
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccaucgccagcagccuggugcugguggugagccugggcgccaucagcuucuggaugugcagcaacggcagccugcagugcagaaucugcaucuga

SEQ ID NO: 160050 - RNA, 1701 nt, Artificial Sequence; identical to SEQ ID NO: 155542
  derived and/or modified sequence opt4 from hemagglutinin__InfluenzaA__AEO01448

SEQ ID NO: 160051 - RNA, 1701 nt, Artificial Sequence; identical to SEQ ID NO: 160025
  derived and/or modified sequence opt4 from hemagglutinin__InfluenzaA__AEO01449

SEQ ID NO: 160052 - RNA, 1701 nt, Artificial Sequence
  derived and/or modified sequence opt4 from hemagglutinin__InfluenzaA__AEO01450
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcaccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagcacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160053 - RNA, 1701 nt, Artificial Sequence; identical to SEQ ID NO: 155189
  derived and/or modified sequence opt4 from hemagglutinin__InfluenzaA__AEO01451

SEQ ID NO: 160054 - RNA, 1701 nt, Artificial Sequence
  derived and/or modified sequence opt4 from hemagglutinin__InfluenzaA__AEO01452
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccgaggccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgcccacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaagcuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160055 - RNA, 1701 nt, Artificial Sequence
  derived and/or modified sequence opt4 from hemagglutinin__InfluenzaA__AEO01453
augaaggccauccugguggugcugcuguacaccuucgccaucgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcgugcaccaccccagcaccagcgccgaccagcagagccuguaccagaacgccgacgccuacguguucgugggcaccagcagauacagcaagaaguucaagagagagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagcacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucaacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160056 - RNA, 1701 nt, Artificial Sequence
  derived and/or modified sequence opt4 from hemagglutinin__InfluenzaA__AEO01454
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaccaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160057 - RNA, 1701 nt, Artificial Sequence
  derived and/or modified sequence opt4 from hemagglutinin__InfluenzaA__AEO01455
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160058 - RNA, 1701 nt, Artificial Sequence
  derived and/or modified sequence opt4 from hemagglutinin__InfluenzaA__AEO01456
augaaggccauccugaucgugcugcuguacaccuucgccaccgccaacgccgacacccugugcaucggcuaccacgccaacaacagcaccgacaccguggacacccugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggacagaaacgccggcagcggcaucaucaucagcgacgcccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160059 - RNA, 1701 nt, Artificial Sequence; identical to SEQ ID NO: 159958
  derived and/or modified sequence opt4 from hemagglutinin__InfluenzaA__AEO01457

SEQ ID NO: 160060 - RNA, 1701 nt, Artificial Sequence; identical to SEQ ID NO: 159954
  derived and/or modified sequence opt4 from hemagglutinin__InfluenzaA__AEO01458

SEQ ID NO: 160061 - RNA, 1701 nt, Artificial Sequence; identical to SEQ ID NO: 159954
  derived and/or modified sequence opt4 from hemagglutinin__InfluenzaA__AEO01459

SEQ ID NO: 160062 - RNA, 1701 nt, Artificial Sequence; identical to SEQ ID NO: 156609
  derived and/or modified sequence opt4 from hemagglutinin__InfluenzaA__AEO01461

SEQ ID NO: 160063 - RNA, 1701 nt, Artificial Sequence; identical to SEQ ID NO: 156290
  derived and/or modified sequence opt4 from hemagglutinin__InfluenzaA__AEO01462

SEQ ID NO: 160064 - RNA, 1701 nt, Artificial Sequence; identical to SEQ ID NO: 155542
  derived and/or modified sequence opt4 from hemagglutinin__InfluenzaA__AEO01463

SEQ ID NO: 160065 - RNA, 1701 nt, Artificial Sequence
  derived and/or modified sequence opt4 from hemagglutinin__InfluenzaA__AEO01464
augaaggccauccugguggugcugcuguacaccuucgccaccgccaacgccgacacccugugcaucggcuaccacgccaacaacagcaccgacaccguggacacccugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggacagaaacgccggcagcggcaucaucaucagcgacaccagcgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160066 - RNA, 1701 nt, Artificial Sequence; identical to SEQ ID NO: 160045
  derived and/or modified sequence opt4 from hemagglutinin__InfluenzaA__AEO01465

SEQ ID NO: 160067 - RNA, 1701 nt, Artificial Sequence; identical to SEQ ID NO: 157061
  derived and/or modified sequence opt4 from hemagglutinin__InfluenzaA__AEO01466

SEQ ID NO: 160068 - RNA, 1701 nt, Artificial Sequence; identical to SEQ ID NO: 155542
  derived and/or modified sequence opt4 from hemagglutinin__InfluenzaA__AEO01467

SEQ ID NO: 160069 - RNA, 1701 nt, Artificial Sequence; identical to SEQ ID NO: 156353
  derived and/or modified sequence opt4 from hemagglutinin__InfluenzaA__AEO01468

SEQ ID NO: 160070 - RNA, 1701 nt, Artificial Sequence; identical to SEQ ID NO: 155189
  derived and/or modified sequence opt4 from hemagglutinin__InfluenzaA__AEO01469

SEQ ID NO: 160071 - RNA, 1701 nt, Artificial Sequence
  derived and/or modified sequence opt4 from hemagglutinin__InfluenzaA__AEO01470
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccuggugauccccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160072 - RNA, 1701 nt, Artificial Sequence; identical to SEQ ID NO: 159898
  derived and/or modified sequence opt4 from hemagglutinin__InfluenzaA__AEO01471

SEQ ID NO: 160073 - RNA, 1701 nt, Artificial Sequence; identical to SEQ ID NO: 156816
  derived and/or modified sequence opt4 from hemagglutinin__InfluenzaA__AEO01472

SEQ ID NO: 160074 - RNA, 1701 nt, Artificial Sequence
  derived and/or modified sequence opt4 from hemagglutinin__InfluenzaA__AEO01473
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugaacaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccgagggcgccaucaacaccagccugcccuuccagaacauccaccccaucaccaucggcgagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160075 - RNA, 1701 nt, Artificial Sequence
  derived and/or modified sequence opt4 from hemagglutinin__InfluenzaA__AEO01474
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcgacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160076 - RNA, 1701 nt, Artificial Sequence
  derived and/or modified sequence opt4 from hemagglutinin__InfluenzaA__AEO01475
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcaacagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagcacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160077 - RNA, 1701 nt, Artificial Sequence
  derived and/or modified sequence opt4 from hemagglutinin__InfluenzaA__AEO01476
augaaggccauccugguggugcugcuguacaccuucagcaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160078 - RNA, 1701 nt, Artificial Sequence
  derived and/or modified sequence opt4 from hemagglutinin__InfluenzaA__AEO01477
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacgccuucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160079 - RNA, 1701 nt, Artificial Sequence; identical to SEQ ID NO: 156517
  derived and/or modified sequence opt4 from hemagglutinin__InfluenzaA__AEO01478

SEQ ID NO: 160080 - RNA, 1701 nt, Artificial Sequence; identical to SEQ ID NO: 159907
  derived and/or modified sequence opt4 from hemagglutinin__InfluenzaA__AEO01479

SEQ ID NO: 160081 - RNA, 1701 nt, Artificial Sequence; identical to SEQ ID NO: 159954
  derived and/or modified sequence opt4 from hemagglutinin__InfluenzaA__AEO01480

SEQ ID NO: 160082 - RNA, 1701 nt, Artificial Sequence
  derived and/or modified sequence opt4 from hemagglutinin__InfluenzaA__AEO01482
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcaacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160083 - RNA, 1701 nt, Artificial Sequence
  derived and/or modified sequence opt4 from hemagglutinin__InfluenzaA__AEO01483
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcaacagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccgccgccagcagccuggugcugguggugagccugggcgccaucagcuucuggaugugcagcaacggcagccugcagugcagaaucugcaucuga

SEQ ID NO: 160084 - RNA, 1701 nt, Artificial Sequence
  derived and/or modified sequence opt4 from hemagglutinin__InfluenzaA__AEO01484
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugaagggcguggccccccugcaccugggcaagugcgacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagcacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160085 - RNA, 1701 nt, Artificial Sequence
  derived and/or modified sequence opt4 from hemagglutinin__InfluenzaA__AEO01485
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucaccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160086 - RNA, 1701 nt, Artificial Sequence
  derived and/or modified sequence opt4 from hemagglutinin__InfluenzaA__AEO01487
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugacccuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160087 - RNA, 1701 nt, Artificial Sequence
  derived and/or modified sequence opt4 from hemagglutinin__InfluenzaA__AEO01488
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacggcaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160088 - RNA, 1701 nt, Artificial Sequence
  derived and/or modified sequence opt4 from hemagglutinin__InfluenzaA__AEO01489
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucagacccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160089 - RNA, 1701 nt, Artificial Sequence
  derived and/or modified sequence opt4 from hemagglutinin__InfluenzaA__AEO01490
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagaauggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160090 - RNA, 1701 nt, Artificial Sequence
  derived and/or modified sequence opt4 from hemagglutinin__InfluenzaA__AEO01491
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaaguacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuaccacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160091 - RNA, 1701 nt, Artificial Sequence; identical to SEQ ID NO: 159958
  derived and/or modified sequence opt4 from hemagglutinin__InfluenzaA__AEO01492

SEQ ID NO: 160092 - RNA, 1701 nt, Artificial Sequence
  derived and/or modified sequence opt4 from hemagglutinin__InfluenzaA__AEO01493
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaagcgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160093 - RNA, 1701 nt, Artificial Sequence
  derived and/or modified sequence opt4 from hemagglutinin__InfluenzaA__AEO01494
augaaggccauccugguggugcugcuguacaccuucgccaccgccaacgccgacacccugugcaccggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160094 - RNA, 1701 nt, Artificial Sequence; identical to SEQ ID NO: 156786
  derived and/or modified sequence opt4 from hemagglutinin__InfluenzaA__AEO01496

SEQ ID NO: 160095 - RNA, 1701 nt, Artificial Sequence; identical to SEQ ID NO: 155542
  derived and/or modified sequence opt4 from hemagglutinin__InfluenzaA__AEO01497

SEQ ID NO: 160096 - RNA, 1701 nt, Artificial Sequence; identical to SEQ ID NO: 156786
  derived and/or modified sequence opt4 from hemagglutinin__InfluenzaA__AEO01498

SEQ ID NO: 160097 - RNA, 1701 nt, Artificial Sequence
  derived and/or modified sequence opt4 from hemagglutinin__InfluenzaA__AEO01499
augaaggccauccugguggugcugcuguacaccuucgccaucgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccuacaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagcacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucaacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160098 - RNA, 1701 nt, Artificial Sequence; identical to SEQ ID NO: 156290
  derived and/or modified sequence opt4 from hemagglutinin__InfluenzaA__AEO01500

SEQ ID NO: 160099 - RNA, 1701 nt, Artificial Sequence; identical to SEQ ID NO: 156353
  derived and/or modified sequence opt4 from hemagglutinin__InfluenzaA__AEO01501

SEQ ID NO: 160100 - RNA, 1701 nt, Artificial Sequence; identical to SEQ ID NO: 156353
  derived and/or modified sequence opt4 from hemagglutinin__InfluenzaA__AEO01502

SEQ ID NO: 160101 - RNA, 1701 nt, Artificial Sequence; identical to SEQ ID NO: 156609
  derived and/or modified sequence opt4 from hemagglutinin__InfluenzaA__AEO01503

SEQ ID NO: 160102 - RNA, 1701 nt, Artificial Sequence; identical to SEQ ID NO: 156786
  derived and/or modified sequence opt4 from hemagglutinin__InfluenzaA__AEO01505

SEQ ID NO: 160103 - RNA, 1701 nt, Artificial Sequence; identical to SEQ ID NO: 156290
  derived and/or modified sequence opt4 from hemagglutinin__InfluenzaA__AEO01506

SEQ ID NO: 160104 - RNA, 1701 nt, Artificial Sequence; identical to SEQ ID NO: 159898
  derived and/or modified sequence opt4 from hemagglutinin__InfluenzaA__AEO01507

SEQ ID NO: 160105 - RNA, 1701 nt, Artificial Sequence; identical to SEQ ID NO: 156786
  derived and/or modified sequence opt4 from hemagglutinin__InfluenzaA__AEO01508

SEQ ID NO: 160106 - RNA, 1701 nt, Artificial Sequence; identical to SEQ ID NO: 156517
  derived and/or modified sequence opt4 from hemagglutinin__InfluenzaA__AEO01510

SEQ ID NO: 160107 - RNA, 1701 nt, Artificial Sequence
  derived and/or modified sequence opt4 from hemagglutinin__InfluenzaA__AEO01511
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcgugaccccccugcaccugggcaagugcaacaucgccggcuggauccugggcaaccccgagugcgagagccugagcaccaccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160108 - RNA, 1701 nt, Artificial Sequence
  derived and/or modified sequence opt4 from hemagglutinin__InfluenzaA__AEO01512
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaagugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160109 - RNA, 1701 nt, Artificial Sequence
  derived and/or modified sequence opt4 from hemagglutinin__InfluenzaA__AEO01513
augaaggccauccuggccgugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccgugaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160110 - RNA, 1701 nt, Artificial Sequence
  derived and/or modified sequence opt4 from hemagglutinin__InfluenzaA__AEO01514
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaugcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160111 - RNA, 1701 nt, Artificial Sequence; identical to SEQ ID NO: 157376
  derived and/or modified sequence opt4 from hemagglutinin__InfluenzaA__AEO01515

SEQ ID NO: 160112 - RNA, 1701 nt, Artificial Sequence; identical to SEQ ID NO: 159958
  derived and/or modified sequence opt4 from hemagglutinin__InfluenzaA__AEO01516

SEQ ID NO: 160113 - RNA, 1701 nt, Artificial Sequence
  derived and/or modified sequence opt4 from hemagglutinin__InfluenzaA__AEO01517
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaaggagaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160114 - RNA, 1701 nt, Artificial Sequence
  derived and/or modified sequence opt4 from hemagglutinin__InfluenzaA__AEO01518
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggaucgugaagaagggcaacagcuaccccaagcugaacaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcgagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160115 - RNA, 1701 nt, Artificial Sequence
  derived and/or modified sequence opt4 from hemagglutinin__InfluenzaA__AEO01519
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucagacccgagaucgccaucagacccaaggugagagagcaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160116 - RNA, 1701 nt, Artificial Sequence; identical to SEQ ID NO: 158094
  derived and/or modified sequence opt4 from hemagglutinin__InfluenzaA__AEO01520

SEQ ID NO: 160117 - RNA, 1701 nt, Artificial Sequence; identical to SEQ ID NO: 156816
  derived and/or modified sequence opt4 from hemagglutinin__InfluenzaA__AEO01521

SEQ ID NO: 160118 - RNA, 1701 nt, Artificial Sequence; identical to SEQ ID NO: 158608
  derived and/or modified sequence opt4 from hemagglutinin__InfluenzaA__AEO01522

SEQ ID NO: 160119 - RNA, 1701 nt, Artificial Sequence; identical to SEQ ID NO: 156353
  derived and/or modified sequence opt4 from hemagglutinin__InfluenzaA__AEO01523

SEQ ID NO: 160120 - RNA, 1701 nt, Artificial Sequence; identical to SEQ ID NO: 159947
  derived and/or modified sequence opt4 from hemagglutinin__InfluenzaA__AEO01524

SEQ ID NO: 160121 - RNA, 1701 nt, Artificial Sequence
  derived and/or modified sequence opt4 from hemagglutinin__InfluenzaA__AEO01525
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcggcaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccagacugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160122 - RNA, 1701 nt, Artificial Sequence; identical to SEQ ID NO: 156353
  derived and/or modified sequence opt4 from hemagglutinin__InfluenzaA__AEO01526

SEQ ID NO: 160123 - RNA, 1701 nt, Artificial Sequence; identical to SEQ ID NO: 159130
  derived and/or modified sequence opt4 from hemagglutinin__InfluenzaA__AEO01527

SEQ ID NO: 160124 - RNA, 1701 nt, Artificial Sequence
  derived and/or modified sequence opt4 from hemagglutinin__InfluenzaA__AEO01529
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggaggugggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccgccgccagcagccuggugcugguggugagccugggcgccaucagcuucuggaugugcagcaacggcagccugcagugcagaaucugcaucuga

SEQ ID NO: 160125 - RNA, 1701 nt, Artificial Sequence; identical to SEQ ID NO: 156353
  derived and/or modified sequence opt4 from hemagglutinin__InfluenzaA__AEO01530

SEQ ID NO: 160126 - RNA, 1701 nt, Artificial Sequence
  derived and/or modified sequence opt4 from hemagglutinin__InfluenzaA__AEO01531
augaaggccauccugguggugcugcuguacaccuucgccaccgccaacaccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaguguaccagauccuggccaucuacagcaccguggccagcagccuggugcugguggugagccugggcgccaucagcuucuggaugugcagcaacggcagccugcagugcagaaucugcaucuga

SEQ ID NO: 160127 - RNA, 1701 nt, Artificial Sequence; identical to SEQ ID NO: 159958
  derived and/or modified sequence opt4 from hemagglutinin__InfluenzaA__AEO01532

SEQ ID NO: 160128 - RNA, 1701 nt, Artificial Sequence
  derived and/or modified sequence opt4 from hemagglutinin__InfluenzaA__AEO01533
augaaggccauccugguggugcugcuguacaccuucgccaccgccaacgccgacacccugugcaucggcuaccacgccaacaacagcaccgacaccguggacaccgugcuggagaagaacgugaccgugacccacagcguggaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160129 - RNA, 1701 nt, Artificial Sequence
  derived and/or modified sequence opt4 from hemagglutinin__InfluenzaA__AEO01534
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagaagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagcacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160130 - RNA, 1701 nt, Artificial Sequence; identical to SEQ ID NO: 156838
  derived and/or modified sequence opt4 from hemagglutinin__InfluenzaA__AEO01535

SEQ ID NO: 160131 - RNA, 1701 nt, Artificial Sequence; identical to SEQ ID NO: 156353
  derived and/or modified sequence opt4 from hemagglutinin__InfluenzaA__AEO01536

SEQ ID NO: 160132 - RNA, 1701 nt, Artificial Sequence; identical to SEQ ID NO: 158094
  derived and/or modified sequence opt4 from hemagglutinin__InfluenzaA__AEO01537

SEQ ID NO: 160133 - RNA, 1701 nt, Artificial Sequence
  derived and/or modified sequence opt4 from hemagglutinin__InfluenzaA__AEO01538
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugggcggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160134 - RNA, 1701 nt, Artificial Sequence; identical to SEQ ID NO: 156816
  derived and/or modified sequence opt4 from hemagglutinin__InfluenzaA__AEO01539

SEQ ID NO: 160135 - RNA, 1701 nt, Artificial Sequence
  derived and/or modified sequence opt4 from hemagglutinin__InfluenzaA__AEO01540
augaaggccauccugguggugcugcuguacaccuucgccaucgccaacgccgacacccugugcaucggcuaccacgccaacaacagcaccgacaccguggacaccgugcuggagaagaacgugaccgugacccacagcgugaaccugcuggaggacaagcacaacgagaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagcacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucaacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160136 - RNA, 1701 nt, Artificial Sequence; identical to SEQ ID NO: 156609
  derived and/or modified sequence opt4 from hemagglutinin__InfluenzaA__AEO01541

SEQ ID NO: 160137 - RNA, 1701 nt, Artificial Sequence; identical to SEQ ID NO: 156353
  derived and/or modified sequence opt4 from hemagglutinin__InfluenzaA__AEO01542

SEQ ID NO: 160138 - RNA, 1701 nt, Artificial Sequence; identical to SEQ ID NO: 156290
  derived and/or modified sequence opt4 from hemagglutinin__InfluenzaA__AEO01543

SEQ ID NO: 160139 - RNA, 1701 nt, Artificial Sequence; identical to SEQ ID NO: 156290
  derived and/or modified sequence opt4 from hemagglutinin__InfluenzaA__AEO01544

SEQ ID NO: 160140 - RNA, 1701 nt, Artificial Sequence
  derived and/or modified sequence opt4 from hemagglutinin__InfluenzaA__AEO01545
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacagcggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucguggacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160141 - RNA, 1701 nt, Artificial Sequence; identical to SEQ ID NO: 155176
  derived and/or modified sequence opt4 from hemagglutinin__InfluenzaA__AEO01546

SEQ ID NO: 160142 - RNA, 1701 nt, Artificial Sequence; identical to SEQ ID NO: 155176
  derived and/or modified sequence opt4 from hemagglutinin__InfluenzaA__AEO01547

SEQ ID NO: 160143 - RNA, 1701 nt, Artificial Sequence; identical to SEQ ID NO: 155369
  derived and/or modified sequence opt4 from hemagglutinin__InfluenzaA__AEO01548

SEQ ID NO: 160144 - RNA, 1701 nt, Artificial Sequence; identical to SEQ ID NO: 155280
  derived and/or modified sequence opt4 from hemagglutinin__InfluenzaA__AEO01549

SEQ ID NO: 160145 - RNA, 1701 nt, Artificial Sequence; identical to SEQ ID NO: 155189
  derived and/or modified sequence opt4 from hemagglutinin__InfluenzaA__AEO01550

SEQ ID NO: 160146 - RNA, 1701 nt, Artificial Sequence; identical to SEQ ID NO: 155189
  derived and/or modified sequence opt4 from hemagglutinin__InfluenzaA__AEO01551

SEQ ID NO: 160147 - RNA, 1701 nt, Artificial Sequence; identical to SEQ ID NO: 155189
  derived and/or modified sequence opt4 from hemagglutinin__InfluenzaA__AEO01552

SEQ ID NO: 160148 - RNA, 1701 nt, Artificial Sequence; identical to SEQ ID NO: 155189
  derived and/or modified sequence opt4 from hemagglutinin__InfluenzaA__AEO01553

SEQ ID NO: 160149 - RNA, 1701 nt, Artificial Sequence; identical to SEQ ID NO: 155189
  derived and/or modified sequence opt4 from hemagglutinin__InfluenzaA__AEO01554

SEQ ID NO: 160150 - RNA, 1701 nt, Artificial Sequence; identical to SEQ ID NO: 155369
  derived and/or modified sequence opt4 from hemagglutinin__InfluenzaA__AEO01555

SEQ ID NO: 160151 - RNA, 1701 nt, Artificial Sequence; identical to SEQ ID NO: 155189
  derived and/or modified sequence opt4 from hemagglutinin__InfluenzaA__AEO01557

SEQ ID NO: 160152 - RNA, 1701 nt, Artificial Sequence; identical to SEQ ID NO: 155189
  derived and/or modified sequence opt4 from hemagglutinin__InfluenzaA__AEO01558

SEQ ID NO: 160153 - RNA, 1701 nt, Artificial Sequence
  derived and/or modified sequence opt4 from hemagglutinin__InfluenzaA__AEO01559
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcaggacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160154 - RNA, 1701 nt, Artificial Sequence; identical to SEQ ID NO: 155189
  derived and/or modified sequence opt4 from hemagglutinin__InfluenzaA__AEO01560

SEQ ID NO: 160155 - RNA, 1701 nt, Artificial Sequence; identical to SEQ ID NO: 155189
  derived and/or modified sequence opt4 from hemagglutinin__InfluenzaA__AEO01561

SEQ ID NO: 160156 - RNA, 1701 nt, Artificial Sequence; identical to SEQ ID NO: 155189
  derived and/or modified sequence opt4 from hemagglutinin__InfluenzaA__AEO01562

SEQ ID NO: 160157 - RNA, 1701 nt, Artificial Sequence; identical to SEQ ID NO: 155189
  derived and/or modified sequence opt4 from hemagglutinin__InfluenzaA__AEO01563

SEQ ID NO: 160158 - RNA, 1701 nt, Artificial Sequence; identical to SEQ ID NO: 155189
  derived and/or modified sequence opt4 from hemagglutinin__InfluenzaA__AEO01564

SEQ ID NO: 160159 - RNA, 1701 nt, Artificial Sequence; identical to SEQ ID NO: 155189
  derived and/or modified sequence opt4 from hemagglutinin__InfluenzaA__AEO01565

SEQ ID NO: 160160 - RNA, 1701 nt, Artificial Sequence; identical to SEQ ID NO: 155176
  derived and/or modified sequence opt4 from hemagglutinin__InfluenzaA__AEO01566

SEQ ID NO: 160161 - RNA, 1701 nt, Artificial Sequence; identical to SEQ ID NO: 155431
  derived and/or modified sequence opt4 from hemagglutinin__InfluenzaA__AEO01567

SEQ ID NO: 160162 - RNA, 1701 nt, Artificial Sequence; identical to SEQ ID NO: 155371
  derived and/or modified sequence opt4 from hemagglutinin__InfluenzaA__AEO01568

SEQ ID NO: 160163 - RNA, 1701 nt, Artificial Sequence; identical to SEQ ID NO: 155371
  derived and/or modified sequence opt4 from hemagglutinin__InfluenzaA__AEO01569

SEQ ID NO: 160164 - RNA, 1701 nt, Artificial Sequence; identical to SEQ ID NO: 155431
  derived and/or modified sequence opt4 from hemagglutinin__InfluenzaA__AEO01570

SEQ ID NO: 160165 - RNA, 1701 nt, Artificial Sequence; identical to SEQ ID NO: 155371
  derived and/or modified sequence opt4 from hemagglutinin__InfluenzaA__AEO01571

SEQ ID NO: 160166 - RNA, 1701 nt, Artificial Sequence; identical to SEQ ID NO: 155431
  derived and/or modified sequence opt4 from hemagglutinin__InfluenzaA__AEO01572

SEQ ID NO: 160167 - RNA, 1701 nt, Artificial Sequence; identical to SEQ ID NO: 155176
  derived and/or modified sequence opt4 from hemagglutinin__InfluenzaA__AEO01573

SEQ ID NO: 160168 - RNA, 1701 nt, Artificial Sequence; identical to SEQ ID NO: 155189
  derived and/or modified sequence opt4 from hemagglutinin__InfluenzaA__AEO01574

SEQ ID NO: 160169 - RNA, 1701 nt, Artificial Sequence; identical to SEQ ID NO: 155176
  derived and/or modified sequence opt4 from hemagglutinin__InfluenzaA__AEO01575

SEQ ID NO: 160170 - RNA, 1701 nt, Artificial Sequence; identical to SEQ ID NO: 155176
  derived and/or modified sequence opt4 from hemagglutinin__InfluenzaA__AEO01576

SEQ ID NO: 160171 - RNA, 1701 nt, Artificial Sequence; identical to SEQ ID NO: 155176
  derived and/or modified sequence opt4 from hemagglutinin__InfluenzaA__AEO01577

SEQ ID NO: 160172 - RNA, 1701 nt, Artificial Sequence; identical to SEQ ID NO: 155431
  derived and/or modified sequence opt4 from hemagglutinin__InfluenzaA__AEO01578

SEQ ID NO: 160173 - RNA, 1701 nt, Artificial Sequence; identical to SEQ ID NO: 155431
  derived and/or modified sequence opt4 from hemagglutinin__InfluenzaA__AEO01579

SEQ ID NO: 160174 - RNA, 1701 nt, Artificial Sequence; identical to SEQ ID NO: 155176
  derived and/or modified sequence opt4 from hemagglutinin__InfluenzaA__AEO01581

SEQ ID NO: 160175 - RNA, 1701 nt, Artificial Sequence; identical to SEQ ID NO: 155176
  derived and/or modified sequence opt4 from hemagglutinin__InfluenzaA__AEO01582

SEQ ID NO: 160176 - RNA, 1701 nt, Artificial Sequence; identical to SEQ ID NO: 155176
  derived and/or modified sequence opt4 from hemagglutinin__InfluenzaA__AEO01583

SEQ ID NO: 160177 - RNA, 1701 nt, Artificial Sequence; identical to SEQ ID NO: 155176
  derived and/or modified sequence opt4 from hemagglutinin__InfluenzaA__AEO01584

SEQ ID NO: 160178 - RNA, 1701 nt, Artificial Sequence; identical to SEQ ID NO: 155176
  derived and/or modified sequence opt4 from hemagglutinin__InfluenzaA__AEO01585

SEQ ID NO: 160179 - RNA, 1701 nt, Artificial Sequence; identical to SEQ ID NO: 155176
  derived and/or modified sequence opt4 from hemagglutinin__InfluenzaA__AEO01586

SEQ ID NO: 160180 - RNA, 1701 nt, Artificial Sequence; identical to SEQ ID NO: 155176
  derived and/or modified sequence opt4 from hemagglutinin__InfluenzaA__AEO01587

SEQ ID NO: 160181 - RNA, 1701 nt, Artificial Sequence; identical to SEQ ID NO: 155176
  derived and/or modified sequence opt4 from hemagglutinin__InfluenzaA__AEO01588

SEQ ID NO: 160182 - RNA, 1701 nt, Artificial Sequence; identical to SEQ ID NO: 155189
  derived and/or modified sequence opt4 from hemagglutinin__InfluenzaA__AEO01589

SEQ ID NO: 160183 - RNA, 1701 nt, Artificial Sequence; identical to SEQ ID NO: 155189
  derived and/or modified sequence opt4 from hemagglutinin__InfluenzaA__AEO01590

SEQ ID NO: 160184 - RNA, 1701 nt, Artificial Sequence; identical to SEQ ID NO: 155189
  derived and/or modified sequence opt4 from hemagglutinin__InfluenzaA__AEO01591

SEQ ID NO: 160185 - RNA, 1701 nt, Artificial Sequence; identical to SEQ ID NO: 155176
  derived and/or modified sequence opt4 from hemagglutinin__InfluenzaA__AEO01592

SEQ ID NO: 160186 - RNA, 1701 nt, Artificial Sequence; identical to SEQ ID NO: 155189
  derived and/or modified sequence opt4 from hemagglutinin__InfluenzaA__AEO01593

SEQ ID NO: 160187 - RNA, 1701 nt, Artificial Sequence; identical to SEQ ID NO: 155176
  derived and/or modified sequence opt4 from hemagglutinin__InfluenzaA__AEO01594

SEQ ID NO: 160188 - RNA, 1701 nt, Artificial Sequence; identical to SEQ ID NO: 155176
  derived and/or modified sequence opt4 from hemagglutinin__InfluenzaA__AEO01595

SEQ ID NO: 160189 - RNA, 1701 nt, Artificial Sequence; identical to SEQ ID NO: 155369
  derived and/or modified sequence opt4 from hemagglutinin__InfluenzaA__AEO01596

SEQ ID NO: 160190 - RNA, 1701 nt, Artificial Sequence; identical to SEQ ID NO: 155189
  derived and/or modified sequence opt4 from hemagglutinin__InfluenzaA__AEO01597

SEQ ID NO: 160191 - RNA, 1701 nt, Artificial Sequence
  derived and/or modified sequence opt4 from hemagglutinin__InfluenzaA__AEO01598
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagauguuccccaagaccagcagcuggcccaaccacgacagcaacaacggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160192 - RNA, 1701 nt, Artificial Sequence; identical to SEQ ID NO: 155189
  derived and/or modified sequence opt4 from hemagglutinin__InfluenzaA__AEO01599

SEQ ID NO: 160193 - RNA, 1701 nt, Artificial Sequence; identical to SEQ ID NO: 155189
  derived and/or modified sequence opt4 from hemagglutinin__InfluenzaA__AEO01600

SEQ ID NO: 160194 - RNA, 1701 nt, Artificial Sequence; identical to SEQ ID NO: 155189
  derived and/or modified sequence opt4 from hemagglutinin__InfluenzaA__AEO01601

SEQ ID NO: 160195 - RNA, 1701 nt, Artificial Sequence; identical to SEQ ID NO: 155189
  derived and/or modified sequence opt4 from hemagglutinin__InfluenzaA__AEO01602

SEQ ID NO: 160196 - RNA, 1701 nt, Artificial Sequence; identical to SEQ ID NO: 155189
  derived and/or modified sequence opt4 from hemagglutinin__InfluenzaA__AEO01603

SEQ ID NO: 160197 - RNA, 1701 nt, Artificial Sequence; identical to SEQ ID NO: 155189
  derived and/or modified sequence opt4 from hemagglutinin__InfluenzaA__AEO01604

SEQ ID NO: 160198 - RNA, 1701 nt, Artificial Sequence; identical to SEQ ID NO: 155189
  derived and/or modified sequence opt4 from hemagglutinin__InfluenzaA__AEO01605

SEQ ID NO: 160199 - RNA, 1701 nt, Artificial Sequence
  derived and/or modified sequence opt4 from hemagglutinin__InfluenzaA__AEO01606
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugaagagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160200 - RNA, 1701 nt, Artificial Sequence; identical to SEQ ID NO: 155431
  derived and/or modified sequence opt4 from hemagglutinin__InfluenzaA__AEO01607

SEQ ID NO: 160201 - RNA, 1701 nt, Artificial Sequence; identical to SEQ ID NO: 158094
  derived and/or modified sequence opt4 from hemagglutinin__InfluenzaA__AEO01608

SEQ ID NO: 160202 - RNA, 1701 nt, Artificial Sequence; identical to SEQ ID NO: 159954
  derived and/or modified sequence opt4 from hemagglutinin__InfluenzaA__AEO01609

SEQ ID NO: 160203 - RNA, 1701 nt, Artificial Sequence
  derived and/or modified sequence opt4 from hemagglutinin__InfluenzaA__AEO01610
augaaggccauccugguggugcugcuguacaccuucgccaccaccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagcacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagagugugcaucuga

SEQ ID NO: 160204 - RNA, 1701 nt, Artificial Sequence
  derived and/or modified sequence opt4 from hemagglutinin__InfluenzaA__AEO01611
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcagagaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcgagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccgccgccagcagccuggugcugguggugagccugggcgccaucagcuucuggaugugcagcaacggcagccugcagugcagaaucugcaucuga

SEQ ID NO: 160205 - RNA, 1701 nt, Artificial Sequence
  derived and/or modified sequence opt4 from hemagglutinin__InfluenzaA__AEO01612
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgccaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160206 - RNA, 1701 nt, Artificial Sequence; identical to SEQ ID NO: 157786
  derived and/or modified sequence opt4 from hemagglutinin__InfluenzaA__AEO01613

SEQ ID NO: 160207 - RNA, 1701 nt, Artificial Sequence
  derived and/or modified sequence opt4 from hemagglutinin__InfluenzaA__AEO01614
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugaagggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160208 - RNA, 1701 nt, Artificial Sequence
  derived and/or modified sequence opt4 from hemagglutinin__InfluenzaA__AEO01615
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaaguacuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160209 - RNA, 1701 nt, Artificial Sequence; identical to SEQ ID NO: 155542
  derived and/or modified sequence opt4 from hemagglutinin__InfluenzaA__AEO01616

SEQ ID NO: 160210 - RNA, 1701 nt, Artificial Sequence; identical to SEQ ID NO: 156353
  derived and/or modified sequence opt4 from hemagglutinin__InfluenzaA__AEO01617

SEQ ID NO: 160211 - RNA, 1701 nt, Artificial Sequence; identical to SEQ ID NO: 156786
  derived and/or modified sequence opt4 from hemagglutinin__InfluenzaA__AEO01619

SEQ ID NO: 160212 - RNA, 1701 nt, Artificial Sequence; identical to SEQ ID NO: 159898
  derived and/or modified sequence opt4 from hemagglutinin__InfluenzaA__AEO01620

SEQ ID NO: 160213 - RNA, 1701 nt, Artificial Sequence; identical to SEQ ID NO: 160045
  derived and/or modified sequence opt4 from hemagglutinin__InfluenzaA__AEO01621

SEQ ID NO: 160214 - RNA, 1701 nt, Artificial Sequence
  derived and/or modified sequence opt4 from hemagglutinin__InfluenzaA__AEO01625
augaagaccaucaucgcccugagcuacauccugugccuggugagcgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccaggugcuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccacagcaaguucaaguaccccgcccugaacgugaccaugcccaacaacgaggaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgagguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160215 - RNA, 1701 nt, Artificial Sequence
  derived and/or modified sequence opt4 from hemagglutinin__InfluenzaA__AEO01636
augaagagcaucaucgcccugagcuacauccugugccuggugagcgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccaggugcuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccacagcaaguucaaguaccccgcccugaacgugaccaugcccaacaacgaggaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160216 - RNA, 1701 nt, Artificial Sequence
  derived and/or modified sequence opt4 from hemagglutinin__InfluenzaA__AEO01642
augaagaccaucaucgcccugagcuacauccugugccuggugagcgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgaggaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcaagugcaucacccccaacggcagcauccccaacgacaagcccuuccagaacgugaacagagugaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160217 - RNA, 1698 nt, Artificial Sequence
  derived and/or modified sequence opt4 from hemagglutinin__InfluenzaA__AEO01663
augaaggugaagcugcuggugcugcugugcaccuucgccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugagagcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugcccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugagacuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 160218 - RNA, 1698 nt, Artificial Sequence
  derived and/or modified sequence opt4 from hemagglutinin__InfluenzaA__AEO01674
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacgagaaccugaaggcccccagauacgccuucgcccugagcagaggcuucggcagcggcaucaucaacagcaaggcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugagacuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 160219 - RNA, 1701 nt, Artificial Sequence; identical to SEQ ID NO: 160214
  derived and/or modified sequence opt4 from hemagglutinin__InfluenzaA__AEO01691

SEQ ID NO: 160220 - RNA, 1698 nt, Artificial Sequence
  derived and/or modified sequence opt4 from hemagglutinin__InfluenzaA__AEO01699
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccagagacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccccagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcgccuaccagauccuggccaucuacagcaccggcgccagcagccuggugcugcuggugagccugggcgccaucagcuucuggaugugcagcaacggcagccugcagagaagaaucugcaucuga

SEQ ID NO: 160221 - RNA, 1698 nt, Artificial Sequence
  derived and/or modified sequence opt4 from hemagglutinin__InfluenzaA__AEO01709
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaaaguucacccccgagaucgccaagagacccaagcugagagaccaggacggcagaaucaacuacuacuggacccugcuggagcccggcgacaccaccaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgagcuguaccugaagugcaacggcgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 160222 - RNA, 1701 nt, Artificial Sequence; identical to SEQ ID NO: 156353
  derived and/or modified sequence opt4 from hemagglutinin__InfluenzaA__AEO37530

SEQ ID NO: 160223 - RNA, 1701 nt, Artificial Sequence
  derived and/or modified sequence opt4 from hemagglutinin__InfluenzaA__AEO72176
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcuggccgugagccugggcgccaucagcuucuggaugugcagcaacggcagccugcagugcagaaucugcaucuga

SEQ ID NO: 160224 - RNA, 1704 nt, Artificial Sequence
  derived and/or modified sequence opt4 from hemagglutinin__InfluenzaA__AEO88980
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgccaacgaccugugcuaccccggcaacuucaacgacuacgaggagcugaagcaccugcugagcagaaucaaccacuucgagaagauccagaucauccccaagagcagcuggagcgaccacgaggccagcagcggcgugagcagcgccugccccuaccagggcacccccagcuucuucagaaacgugguguggcugaucaagaagaacaacaccuaccccaccaucaagagaagcuacaacaacaccaaccaggaggaccugcugauccuguggggcauccaccacagcaacgacgccgccgagcagaccaagcuguaccagaaccccaccaccuacaucagcgugggcaccagcacccugaaccagagacuggugcccaagaucgccaccagaagcaaggugaacggccagagcggcagaauggacuucuucuggaccauccugaagcccaacgacgccaucaacuucgagagcaacggcaacuucaucgcccccgaguacgccuacaagaucgugaagaagggcgacagcgccaucaugaagagcgagguggaguacggcaacugcaacaccaagugccagacccccaucggcgccaucaacagcagcaugcccuuccacaacauccacccccugaccaucggcgagugccccaaguacgugaagagcaacaagcuggugcuggccaccggccugagaaacagcccccugagagagagaagaagaaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccugagccuguggaugugcagcaacggcagccugcagugcagaaucugcaucuga

SEQ ID NO: 160225 - RNA, 1704 nt, Artificial Sequence
  derived and/or modified sequence opt4 from hemagglutinin__InfluenzaA__AEO89021
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgccaacgaccugugcuaccccggcaacuucaacgacuacgaggagcugaagcaccugcugagcagaaucaaccacuucgagaagauccccaucauccccaagagcagcuggagcgaccacgaggccagcagcggcgugagcagcgccugccccuaccagggcacccccagcuucuucagaaacgugguguggcugaucaagaagaacaacaccuaccccaccaucaagagaagcuacaacaacaccaaccaggaggaccugcugauccuguggggcauccaccacagcaacaacgccgccgagcagaccaagcuguaccagaaccccaccaccuacaucagcgugggcaccagcacccugaaccugagacuggugcccaagaucgccaccagaagcaaggugaacggccagagcggcagaauggacuucuucuggaccauccugaagcccaacgacgccaucaacuucgagagcaacggcaacuucaucgcccccgaguacgccuacaagaucgugaagaagggcgacagcgccaucaugaagagcgagguggaguacggcaacugcaacaccaagugccagacccccaucggcgccaucaacagcagcaugcccuuccacaacauccacccccugaccaucggcgagugccccaaguacgugaagagcaacaagcuggugcuggccaccggccugagaaacagcccccugagagagagaagaagaaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccugagccuguggaugugcagcaacggcagccugcagugcagaaucugcaucuga

SEQ ID NO: 160226 - RNA, 1704 nt, Artificial Sequence
  derived and/or modified sequence opt4 from hemagglutinin__InfluenzaA__AEO89030
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgccaacgaccugugcuaccccggcaacuucaacgacuacgaggagcugaagcaccugcugagcagaaucaaccacuucgagaagauccagaucauccccaagagcagcuggagcgaccacgaggccagcagcggcgugagcagcgugugccccuaccagggcacccccagcuucuucagaaacgugguguggcugaucaagaagaacaacaccuaccccaccaucaagagaagcuacaacaacaccaaccaggaggaccugcugauccuguggggcauccaccacagcaacgacgccgccgagcagaccaagcuguaccagaaccccaccaccuacaucagcgugggcaccagcacccugaaccagagacuggugcccaagaucgccaccagaagcaaggugaacggccagagcggcagaauggacuucuucuggaccgugcugaagcccaacgacgccaucaacuucgagagcaacggcaacuucaucgcccccgaguacgccuacaagaucgugaagaagggcgacagcgccaucaugaagagcgagguggaguacggcaacugcaacaccaagugccagacccccaucggcgccaucaacagcagcaugcccuuccacaacauccacccccugaccaucggcgagugccccaaguacgugaagagcaacaagcuggugcuggccaccggccugagaaacagcccccugagagagagaagaagaaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccugagccuguggaugugcagcaacggcagccugcagugcagaaucugcaucuga

SEQ ID NO: 160227 - RNA, 1704 nt, Artificial Sequence
  derived and/or modified sequence opt4 from hemagglutinin__InfluenzaA__AEO89048
auggagaagaucguguuccugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgccaacgaccugugcuaccccggcaacuucaacgacuacgaggagcugaagcaccugcugagcagaaucaaccacuucgagaagauccagaucauccccaagagcagcuggagcgaccacgaggccagcagcggcgugagcagcgccugccccuaccagggcacccccagcuucuucagaaacgugaucuggcugaucaagaagaacaacaccuaccccaccaucaagagaagcuacaacaacaccaaccaggaggaccugcugauccuguggggcauccaccacagcaacgacgccgccgagcagaccaagcuguaccagaaccccaccaccuacaucagcgugggcaccagcacccugaaccagagacuggugcccaagaucgccaccagaagcaaggugaacggccagagcggcagaauggacuucuucuggaccauccugaagcccaacgacgccaucaacuucgagagcaacggcaacuucaucgcccccgaguacgccuacaagaucgugaagaagggcgacagcgccauccugaagagcgagguggaguacggcaacugcaacaccaagugccagacccccaucggcgccaucaacagcagcaugcccuuccacaacauccacccccugaccaucggcgagugccccaaguacgugaagagcaacaagcuggugcuggccaccggccugagaaacagcccccugagagagagaagaagaaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccugagccuguggaugugcagcaacggcagccugcagugcagaaucugcaucuga

SEQ ID NO: 160228 - RNA, 1704 nt, Artificial Sequence
  derived and/or modified sequence opt4 from hemagglutinin__InfluenzaA__AEO89065
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgccaacgaccugugcuaccccggcaacuucaacgacuacgaggagcugaagcaccugcugagcagaaucaaccacuucgagaagauccagaucauccccaagagcagcuggagcgaccacgaggccagcagcggcgugagcagcgugugccccuaccagggcacccccagcuucuucagaaacgugguguggcugaucaagaagaacaacaccuaccccaccaucaagagaagcuacaacaacaccaaccaggaggaccugcugauccuguggggcauccaccacagcaacgacgccgccgagcagaccaagcuguaccagaaccccaccaccuacaucagcgugggcaccagcacccugaaccugagacuggugcccaagaucgccaccagaagcaaggugaacggccagagcggcagaauggacuucuucuggaccauccugaagcccagcgacgccaucaacuucgagagcaacggcaacuucaucgcccccgaguacgccuacaagaucgugaagaagggcgacagcgccaucaugaagagcgagguggaguacggcaacugcaacaccaagugccagacccccaucggcgccaucaacagcagcaugcccuuccacaacauccacccccugaccaucggcgagugccccaaguacgugaagagcaacaagcuggugcuggccaccggccugagaaacagcccccugagagagagaagaagaaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccugagccuguggaugugcagcaacggcagccugcagugcagaaucugcaucuga

SEQ ID NO: 160229 - RNA, 1704 nt, Artificial Sequence
  derived and/or modified sequence opt4 from hemagglutinin__InfluenzaA__AEO89082
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgccaacgaccugugcuaccccggcaacuucaacgacuacgaggagcugaagcaccugcugagcagaaucaaccacuucgagaagauccagaucauccccaagagcagcuggagcgaccacgacaccagcagcggcgugagcagcgccugccccuaccagggcacccccagcuucuucagaaacgugguguggcugaucaagaagaacaacaccuaccccaccaucaagagaagcuacaacaacaccaacaaggaggaccugcugauccuguggggcauccaccacagcaacgacgccgccgagcagaccaagcuguaccagaaccccaccaccuacaucagcgugggcaccagcacccugaaccagagacuggugcccaagaucgccaccagaagcaaggugaacggccagagcggcagaauggacuucuucuggaccauccugaagcccaacgacgccaucaacuucgagagcaacggcaacuucaucgcccccgaguacgccuacaagaucgugaagaagggcgacagcgccaucaugaagagcgagguggaguacggcaacugcaacaccaagugccagacccccaucggcgccaucaacagcagcaugcccuuccacaacauccacccccugaccaucggcgagugccccaaguacgugaagagcaacaagcuggugcuggccaccggccugagaaacagcccccugagagagagaagaagaaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccugagccuguggaugugcagcaacggcagccugcagugcagaaucugcaucuga

SEQ ID NO: 160230 - RNA, 1704 nt, Artificial Sequence
  derived and/or modified sequence opt4 from hemagglutinin__InfluenzaA__AEO89091
auggagaagaccguguuccugcuggccaucgugagccuggugaagagcgaccagaucugcaucggcuaccacgccaacaacagcaccgagcagguggacaccaucauggagaagaacgugaccgugacccacgcccagaacauccuggagaagacccacaacggcaagcugugcgacaucgacggcgugaagccccugauccugaaggacugcagcguggccggcuggcugcugggcaaccccaugugcgacgaguucaucaacgugcccgaguggagcuacaucguggagaaggccaaccccgccaacgaccugugcuaccccggcaacuucaacgacuacgaggagcugaagcaccugcugagcagaaucaaccacuucgagaagauccagaucauccccaagagcagcuggagcgaccacgaggccagcagcggcgugagcagcaccugccccuaccagggcacccccagcuucuucagaaacgugguguggcugaucaagaagaacaacaccuaccccaccaucaagagaagcuacaacaacaccaaccaggaggaccugcugauccuguggggcauccaccacagcaacgacgaggccgagcaggccaagcuguaccagaaccccaccaccuacaucagcgugggcaccagcacccugaaccagagacuggugcccaagaucgccaccagaagcaaggugaacggccagagcggcagaauggacuucuucuggaccauccugaagcccaacgacgccaucaacuucgagagcaacggcaacuucaucgcccccgaguacgccuacaagaucgugaagaagggcgacagcgccaucaugaagagcgagguggaguacggcaacugcaacaccaagugccagacccccaucggcgccaucaacagcagcaugcccuuccacaacauccacccccugaccaucggcgagugccccaaguacgugaagagcaacaagcuggugcuggccaccggccugagaaacagcccccugagagagagaagaagaaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacgacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugauggccggccugagccuguggaugugcagcaacggcagccugcagugcagaaucugcaucuga

SEQ ID NO: 160231 - RNA, 1704 nt, Artificial Sequence
  derived and/or modified sequence opt4 from hemagglutinin__InfluenzaA__AEO89100
auggagaagaucgugcccuuccuggccaucaucagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgccaacgaccugugcuaccccggcaacuucaacgacuacgaggagcugaagcaccugcugagcagaaucaaccacuucgagaagauccagaucauccccaagaacagcuggagcgaccacgaggccagcagcggcgugagcagcgccugccccuaccagggcacccccagcuucuucagaaacgugguguggcugaucaagaagaacaacaccuaccccaccaucaagagaagcuacaacaacaccaaccaggaggaccugcugauccuguggggcauccaccacagcaacgacgccgccgagcagaccaagcuguaccagaaccccaccaccuacaucagcgugggcaccagcacccugaaccagagacuggugcccaagaucgccaccagaagcaaggugaacggccagagcggcagaauggacuucuucuggaccauccugaagcccaacgacgccaucaacuucgagagcaacggcaacuucaucgcccccgaguacgccuacaagaucgugaagaagggcgacagcgccaucaugaagagcgagguggaguacggcaacugcaacaccaagugccagacccccaucggcgccaucaacagcagcaugcccuuccacaacauccacccccugaccaucggcgagugccccaaguacgugaagagcaacaagcuggugcuggccaccggccugagaaacagcccccugagagagagaagaagaaagagaggccuguucggcgccaucgccggcuucaucgagggcggcuggcagggcaugguggacggcugguacggcuuccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacgacgagugcauggagagcgugaagaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccugagccuguggaugugcagcaacggcagccugcagugcagaaucugcaucuga

SEQ ID NO: 160232 - RNA, 1704 nt, Artificial Sequence
  derived and/or modified sequence opt4 from hemagglutinin__InfluenzaA__AEO89109
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgccaacgaccugugcuaccccggcaacuucaacgacuacgaggagcugaagcaccugcugagcagaaucaaccacuucgagaagauccagaucauccccaagagcagcuggagcgaccacgaggccagcagcggcgugagcagcgccugccccuaccagggcacccccagcuucuucagaaacgugguguggcugaucaagaagaacaacaccuaccccaccaucaagagaagcuacaacaacaccaaccaggagaaccugcugauccuguggggcauccaccacagcaacgacgccgccgagcagaucaagcuguaccagaaccccaccaccuacaucagcgugggcaccagcacccugaaccagagacuggugaccaagaucgccaccagacccaaggugaacggccagagcggcagaauggacuucuucuggaccauccugaagcccaacgacgccaucaacuucgagagcaacggcaacuucaucgcccccgaguacgccuacaagaucgugaaggagggcgacagcgccaucaugaagagcgagguggaguacggcaacugcaacaccaagugccagacccccaucggcgccaucaacagcagcaugcccuuccacaacauccacccccugaccaucggcgagugccccaaguacgugaagagcaacaagcuggugcuggccaccggccugagaaacagcccccugagagagagaagaagaaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccugagccuguggaugugcagcaacggcagccugcagugcagaaucugcaucuga

SEQ ID NO: 160233 - RNA, 1704 nt, Artificial Sequence
  derived and/or modified sequence opt4 from hemagglutinin__InfluenzaA__AEO89127
auggagaagaucgugcugcugcuggccaucaucagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgccaacgaccugugcuaccccggcaacuucaacgacuacgaggagcugaagcaccugcugagcagaaucaaccacuucgagaagauccagaucauccccaagagcagcuggagcgaccacgaggccagcagcggcgugagcagcgccugccccuaccagggcacccccagcuucuucagaaacgugguguggcugaucaagaagaacaacaccuaccccaccaucaagagaagcuacaacaacaccaaccaggagaaccugcugauccuguggggcauccaccacagcaacgacgccgccgagcagaucaagcuguaccagaaccccaccaccuacaucagcgugggcaccagcacccugaaccagagacuggugcccaagaucgccaccagaagcaaggugaacggccagagcggcagaauggacuucuucuggaccauccugaagcccaacgacgccaucaacuucgagagcaacggcaacuucaucgcccccgaguacgccuacaagaucgugaaggagggcgacagcgccaucaugaagagcgagguggaguacggcaacugcaacaccaagugccagacccccaucggcgccaucaacagcagcaugcccuuccacaacauccacccccugaccaucggcgagugccccaaguacgugaagagcaacaagcuggugcuggccaccggccugagaaacagcccccugagagagagaagaagaagaagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcaucaagcuggagagcaugggcaccuaccagauccugagcaucuacagcaccguggccagcagccuggcccuggccaucaugguggccggccugagccuguggaugugcagcaacggcagccugcagugcagaaucugcaucuga

SEQ ID NO: 160234 - RNA, 1704 nt, Artificial Sequence
  derived and/or modified sequence opt4 from hemagglutinin__InfluenzaA__AEO89145
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugggcgacugcagcguggccggcuggcugcugggcaaccccaugugcgacaaguucaucaacgugcccgaguggagcuacaucguggagaaggccaaccccgccaacgaccugugcuaccccggcaacuucaacgacuacgaggagcugaagcaccugcugagcagaaucaaccacuucgagaagauccagaucauccccaagagcagcuggagcgaccacgaggccagcagcggcgugagcagcgccugccccuaccagggcacccccagcuucuucagaaacgugguguggcugaccaagaagaacaacaccuaccccaccaucaagagaagcuacaacaacaccaaccaggaggaccugcugauccuguggggcauccaccacagcaacaacgccgccgagcaggagaagcuguaccagaaccccaccaccuacaucagcgugggcaccagcacccugaaccagagacuggugcccaagaucgccaccagaagcaaggugaacggccagagcggcagaauggacuucuucuggaccauccugaagcccaacgacgccaucaacuucgagagcaacggcaacuucaucgcccccgaguacgccuacaagaucgugaagaagggcgacagcgccaucaugaagagcggcguggaguacggcaacugcaacaccaagugccagacccccaucggcgccaucaacagcagcaugcccuuccacaacauccacccccugaccaucggcgagugccccaaguacgugaagagcaacaagcuggugcuggccaccggccugagaaacagcccccugagagagagaagaagaaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccgccgccagcagccuggcccuggccaucaugguggccggccugagccuguggaugugcagcaacggcagccugcagugcagaaucugcaucuga

SEQ ID NO: 160235 - RNA, 1707 nt, Artificial Sequence
  derived and/or modified sequence opt4 from hemagglutinin__InfluenzaA__AEO89163
auggagaagaucgugcugcuguucgccaucgugagccuggugaagagcgaccacaucugcaucggcuaccacgccaacaacagcaccgagcagguggacaccaucauggagaagaacgugaccgugacccacgcccaggacauccuggagaagacccacaacggcaagcugugcgaccugaacggcgugaagccccugauccugaaggacugcagcguggccggcuggcugcugggcaaccccaugugcgacgaguucaucgacgugcccgaguggagcuacaucguggagaaggccaaccccgccaacgaccugugcuaccccggcaacuucaacgacuacgaggagcugaagcaccugcugagcagaaucaaccacuucgagaagauccagaucauccccaaggacagcuggcccgaccacgaggccagccugggcgugagcagcgccugccccuaccagggcaacagcagcuucuucagaaacgugguguggcugaucaagaagggcaacgccuaccccaccaucaagaagagcuacaacaacaccaacaaggaggaccugcugauccuguggggcauccaccaccccaacgacgaggccgagcagaccagacuguaccagaaccccaccaccuacaucagcaucggcaccagcacccugaaccagagacuggugcccagaaucgccaccagaagcaaggugaacggccagagcggcagaaucgacuucuucuggaccauccugaagcccaacgacgccaucaacuucgagagcaacggcaacuucaucgcccccgaguacgccuacaagaucgugaagaagggcgacagcaccaucaugaagagcgagguggaguacggcaacugcaacaccagaugccagacccccaugggcgccaucaacagcagcaugcccuuccacaacauccacccccugaccaucggcgagugccccaaguacgugaagagcaacaagcuggugcuggccaccggccugagaaacagcccccagagagagagaagaagaagaaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggugcuggccaucaugguggccggccugagccuguggaugugcagcaacggcagccugcagugcagaaucugcaucuga

SEQ ID NO: 160236 - RNA, 1704 nt, Artificial Sequence
  derived and/or modified sequence opt4 from hemagglutinin__InfluenzaA__AEO89172
auggagaagaucgugcugcugcuggccaucgugagccuggugagaagcgaccagaucugcaucggcuaccacgccaacaacagcaccgagcagguggacaccaucauggagaagaacgugaccgugacccacgcccagaacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgccaacgaccugugcuaccccggcaacuucaacgacuacgaggagcugaagcaccugcugagcagaaucaaccacuucgagaagauccagaucauccccaagagcagcuggagcgaccacgaggccagcagcggcgugagcagcgccugccccuaccagggcacccccagcuucuucagaaacgugguguggcugaucaagaagaacaacaccuaccccaccaucaagagaagcuacaacaacaccaaccaggaggaccugcuggugcuguggggcauccaccacagcaacgacgccaccgagcagaucaagcuguaccagaaccccaccaccuacgugagcgugggcaccagcacccugaaccagagacuggugcccaagaucgccaccagaagcaaggugaacggccagagcggcagaauggacuucuucuggaccauccugaagagcaacgacgccaucaacuucgagagcaacggcaacuucaucgcccccgaguacgccuacaagaucgugaagaagggcgacagcgccaucaugaagagcgagguggaguacggcaacugcagcaccaagugccagacccccaucggcgccaucaacagcagcaugcccuuccacaacauccacccccugaccaucggcgagugccccaaguacgugaagagcaacaagcuggugcuggccaccggccugagaaacagcccccugagagagagaagaagaaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccugagccuguggaugugcagcaacggcagccugcagugcagaaucugcaucuga

SEQ ID NO: 160237 - RNA, 1704 nt, Artificial Sequence
  derived and/or modified sequence opt4 from hemagglutinin__InfluenzaA__AEO89181
auggagaagaucgugcugcuguucgccaccaucagccuggugaagagcgaccacaucugcaucggcuaccacgccaacaacagcaccgagcagguggacaccaucauggagaagaacgugaccgugacccacgcccaggacauccuggagaagacccacaacggcaagcugugcgaccugaacggcgugaagccccugauccugaaggacugcagcguggccggcuggcugcugggcaaccccaugugcgacgaguucaucaacgugcccgaguggagcuacaucguggagaaggccaaccccgccaacgaccugugcuaccccggcaacuucaacgacuacgaggagcugaagcaccugcugagcagaaucaaccacuucgagaagauccagaucauccccaagaacagcuggagcgaccacgaggccagccugggcgugagcgccgccugccccuaccagggcaagagcagcuucuucagaaacgugguguggcugaucaagaaggacaacgccuaccccaccaucaagaagggcuacaacaacaccaaccaggaggaccugcuggugcuguggggcauccaccaccccaacgacgaggccgagcagaccagacuguaccagaaccccaccaccuacaucagcaucggcaccagcacccugaaccagagacuggugcccaagaucgccaccagaagcaagaucaacggccagagcggcagaaucgacuucuucuggaccauccugaagcccaacgacgccauccacuucgagagcaacggcaacuucaucgcccccgaguacgccuacaagaucgugaagaagggcgacagcaccaucaugaagagcgagguggaguacggcaacugcaacaccagaugccagacccccaucggcgccaucaacagcagcaugcccuuccacaacauccacccccugaccaucggcgagugccccaaguacgugaagagcaacaagcuggugcuggccaccggccugagaaacagcccccagagagagagaagaagaaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugagaaaccuguacgacaaggugagacugcagcugaaggacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaucuaccagauccugagcaucuacagcaccguggccagcagccuggugcuggccaucaugauggccggccugagccuguggaugugcagcaacggcagccugcagugcagaaucugcaucuga

SEQ ID NO: 160238 - RNA, 1704 nt, Artificial Sequence
  derived and/or modified sequence opt4 from hemagglutinin__InfluenzaA__AEO89192
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgccaacgaccugugcuaccccggcaacuucaacgacuacgaggagcugaagcaccugcugagcagaaucaaccacuucgagaagauccagaucauccccaagagcagcuggagcgaccacgaggccagcagcggcgugagcagcgccugccccuaccagggcacccccagcuucuucagaaacgugguguggcugaucaagaagaacaacaccuaccccaccaucaagagaagcuacaacaacaccaaccaggagaaccugcugauccuguggggcauccaccacagcaacgacgccgccgagcagaucaagcuguaccagaaccccaccaccuacgugagcaucggcaccagcacccugaaccagagacuggugcccaagaucgccaccagaagcaaggugaacggccagagcggcagaauggacuucuucuggaccauccugaagcccaacgacgccaucaacuucgagagcaacggcaacuucaucgcccccgaguacgccuacaagaucgugaaggagggcgacagcgccaucaugaagagcgagguggaguacggcaacugcaacaccaagugccagacccccaucggcgccaucaacagcagcaugcccuuccacaacauccacccccugaccaucggcgagugccccaaguacgugaagagcaacaagcuggugcuggccaccggccugagaaacagcccccugagagagagaagaagaaagagaggccuguucggcgccaucgccggcuucaucgagggcggcuggcagggcaugguggacggcugguacggcuacccccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucaacggcgugaagcuggagagcaucggcaccuaccagauccugagcaucuacagcaccguggccagcagccuggcccuggccaucaugguggccggccugagccuguggaugugcagcaacggcagccugcagugcagaaucugcaucuga

SEQ ID NO: 160239 - RNA, 1704 nt, Artificial Sequence
  derived and/or modified sequence opt4 from hemagglutinin__InfluenzaA__AEO89203
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgccaacgaccugugcuaccccggcaacuucaacgacuacgaggagcugaagcaccugcugagcagaaucaaccacuucgagaagauccagaucauccccaagagcagcuggagcgaccacgaggccagcagcggcgugagcagcgccugccccuaccagggcacccccagcuucuucagaaacgugguguggcugaucaagaagaacaacaccuaccccaccaucaagagaagcuacaacaacaccaaccaggagaaccugcugauccuguggggcauccaccacagcaacgacgccgccgagcagaucaagcuguaccagaaccccaccaccuacgugagcaucggcaccagcacccugaaccagagacuggugcccaagaucgccaccagaagcaaggugaacggccagagcggcagaauggacuucuucuggaccauccugaagcccaacgacgccaucaacuucgagagcaacggcaacuucaucgcccccgaguacgccuacaagaucgugaaggagggcgacagcgccaucaugaagagcgagguggaguacggcaacugcaacaccaagugccagacccccaucggcgccaucaacagcagcaugcccuuccacaacauccacccccugaccaucggcgagugccccaaguacgugaagagcaacaagcuggugcuggccaccggccugagaaacagcccccugagagagagaagaagaaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucaacggcgugaagcuggagagcaucggcaccuaccagauccugagcaucuacagcaccguggccagcagccuggcccuggccaucaugguggccggccugagccuguggaugugcagcaacggcagccugcagugcagaaucugcaucuga

SEQ ID NO: 160240 - RNA, 1704 nt, Artificial Sequence; identical to SEQ ID NO: 160239
  derived and/or modified sequence opt4 from hemagglutinin__InfluenzaA__AEO89213

SEQ ID NO: 160241 - RNA, 1704 nt, Artificial Sequence; identical to SEQ ID NO: 160239
  derived and/or modified sequence opt4 from hemagglutinin__InfluenzaA__AEO89224

SEQ ID NO: 160242 - RNA, 1704 nt, Artificial Sequence
  derived and/or modified sequence opt4 from hemagglutinin__InfluenzaA__AEO89235
auggagaagaucgugcugcugcuggccauggugagccuggugagaagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgccaacgaccugugcuaccccggcaaccugaacgacuacgaggagcugaagcaccugcugagcagaaucaaccacuucgagaagauccagaucauccccaagagcagcuggagcgaccacgaggccagccugggcgugagcagcgccugccccuaccagggcacccccagcuucuucagaaacgugaucuggcugaucaagaagaacaacaccuaccccaccaucaagagaagcuacaacaacaccaaccaggaggaccugcugauccuguggggcauccaccacagcaacgacgaggccgagcagaucaagcuguaccagaaccccaccaccuacaucagcgugggcaccagcacccugaaccagagacuggugcccaagaucgccaccagaagcaaggugaacggccagagcggcagaauggacuucuucuggaccauccugaagcccgacgacgccaucaacuucgagagcaacggcaacuucaucgcccccgaguacgccuacaagaucgugaagaagggcgacagcgccaucaugaagagcgagguggaguacggcaacugcaacaccaagugccagacccccaucggcgccaucaacagcagcaugcccuuccacaacauccacccccugaccaucggcgagugccccaaguacgugaagagcaacaagcuggugcuggccaccggccugagaaacagcccccugagagagaagagaagaaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccugagccuguggaugugcagcaacggcagccugcagugcagaaucugcaucuga

SEQ ID NO: 160243 - RNA, 1704 nt, Artificial Sequence
  derived and/or modified sequence opt4 from hemagglutinin__InfluenzaA__AEO89246
auggagaagaucgugccccugcuggccauggugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgccaacgaccugugcuaccccggcaaccugaacgacuacgaggagcugaagcaccugcugagcagaaucaaccacuucgagaagauccagaucauccccaagagcagcuggagcgaccacgaggccagccugggcgugagcagcgccugccccuaccagggcacccccagcuucuucagaaacgugguguggcugaucaagaagaacaacaccuaccccaccaucaagagaagcuacaacaacaccaaccaggaggaccugcugauccuguggggcauccaccacagcaacgacgaggccgagcagaucaagcuguaccagaaccccaccaccuacaucagcgugggcaccagcacccugaaccagagacuggugcccaagaucgccaccagaagcaaggugaacggccagagcggcagaauggacuucuucuggaccauccugaagcccgacgacgccaucaacuucgagagcaacggcaacuucaucgcccccgaguacgccuacaagaucgugaagaagggcgacagcgccaucaugaagagcgagguggaguacggcaacugcaacaccaagugccagacccccaucggcgccaucaacagcagcaugcccuuccacaacauccacccccugaccaucggcgagugccccaaguacgugaagagcaacaagcuggugcuggccaccggccugagaaacagcccccugagagagagaagaagaaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucagcaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccugagccuguggaugugcagcaacggcagccugcagugcagaaucugcaucuga

SEQ ID NO: 160244 - RNA, 1704 nt, Artificial Sequence
  derived and/or modified sequence opt4 from hemagglutinin__InfluenzaA__AEO89257
auggagaagaucgugcugcugcuggccaucgugagccuggugagaagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgccaacgaccugugcuaccccggcaacuucaacgacuacgaggagcugaagcaccugcugagcagaaucaaccacuucgagaagauccagaucauccccaagagcagcuggagcgaccacgaggccagcagcggcgugagcagcgccugccccuaccagggcacccccagcuucuucagaaacgugguguggcugaucaagaagaacaacaccuaccccaccaucaagagaagcuacaacaacaccaaccaggaggaccugcuggugcuguggggcauccaccacagcaacgacgccgccgagcagaucaagcuguaccagaaccccaccaccuacgugagcgugggcaccagcacccugaaccagagacuggugcccaagaucgccaccagaagcaaggugaacggccagagcggcagaauggacuucuucuggaccauccugaagagcaacgacgccaucaacuucgagagcaacggcaacuucaucgcccccgaguacgccuacaagaucgugaagaagggcgacagcgccaucaugaagagcgagguggaguacggcaacugcagcaccaagugccagacccccaucggcgccaucaacagcagcaugcccuuccacaacauccacccccugaccaucggcgagugccccaaguacgugaagagcaacaagcuggugcuggccaccggccugagaaacagcccccugagagagagaagaagaaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggugcuggccaucaugguggccggccugagccuguggaugugcagcaacggcagccugcagugcagaaucugcaucuga

SEQ ID NO: 160245 - RNA, 1704 nt, Artificial Sequence; identical to SEQ ID NO: 160244
  derived and/or modified sequence opt4 from hemagglutinin__InfluenzaA__AEO89268

SEQ ID NO: 160246 - RNA, 1704 nt, Artificial Sequence
  derived and/or modified sequence opt4 from hemagglutinin__InfluenzaA__AEO89279
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugggcgacugcagcguggccggcuggcugcugggcaaccccaugugcgacaaguucaucaacgugcccgaguggagcuacaucguggagaaggccaaccccgccaacgaccugugcuaccccggcaacuucaacgacuacgaggagcugaagcaccugcugagcagaaucaaccacuucgagaagauccagaucauccccaagagcagcuggagcgaccacgaggccagcagcggcgugagcagcgccugccccuaccagggcacccccagcuucuucagaaacgugguguggcugaucaagaagaacaacaccuaccccaccaucaagagaagcuacaacaacaccaaccaggaggaccugcugauccuguggggcauccaccacagcaacaacgccgccgagcaggagaagcuguaccagaaccccaccaccuacaucagcgugggcaccagcacccugaaccagagacuggugcccaagaucgccaccagaagcaaggugaacggccagagcggcagaauggacuucuucuggaccauccugaagcccaacgacgccaucaacuucgagagcaacggcaacuucaucgcccccgaguacgccuacaagaucgugaagaagggcgacagcgccaucaugaagagcggcgugaaguacggcaacugcaacaccaagugccagacccccaucggcgccaucaacagcagcaugcccuuccacaacauccacccccugaccaucggcgagugccccaaguacgugaagagcaacaagcuggugcuggccaccggccugagaaacagcccccugagagagagaagaagaaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccgccgccagcagccuggcccuggccaucaugguggccggccugagccuguggaugugcagcaacggcagccugcagugcagaaucugcaucuga

SEQ ID NO: 160247 - RNA, 1704 nt, Artificial Sequence
  derived and/or modified sequence opt4 from hemagglutinin__InfluenzaA__AEO89289
auggagaagaucgugcugcugcuggccaucgugagccuggccaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugggcgacugcagcguggccggcuggcugcugggcaaccccaugugcgacaaguucaucaacgugcccgaguggagcuacaucguggagaaggugaaccccgccaacgaccugugcuaccccggcaacuucaacgacuacgaggagcugaagcaccugcugagcagaaucaaccacuucgagaagaucaagaucauccccaagagcagcuggagcgaccacgaggccagcagcggcgugagcagcgccugccccuaccagggcacccccagcuucuucagaaacgugguguggcugaucaagaagaacaacaccuaccccaccaucaagagaagcuacaacaacaccaaccaggaggaccugcugauccuguggggcauccaccacagcaacaacguggccgagcaggagaagcuguaccagaaccccaccaccuacaucagcgugggcaccagcacccugaaccagagacuggugcccaagaucgccaccagaagcaaggugaacggccagagcggcagaauggacuucuucuggaccauccugaagcccaacgacaccaucaacuucgagagcaacggcaacuucaucgcccccgaguacgccuacaagaucgugaagaagggcgacagcgccaucaugaagagcggcguggaguacggcaacugcaacaccaagugccagacccccaucggcgccaucaacagcagcaugcccuuccacaacauccacccccugaccaucggcgagugccccaaguacgugaagagcaacaagcuggugcuggccaccggccugagaaacagcccccugagagagagaagaagaaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuaccccagauacagcgaggaggccagacugaagagagaggagaucagcggcgugaagcuggagagcaucggcaccuaccagauccugagcaucuacagcaccgccgccagcagccuggcccuggccaucaugguggccggccugagccuguggaugugcagcaacggcagccugcagugcagaaucugcaucuga

SEQ ID NO: 160248 - RNA, 1704 nt, Artificial Sequence
  derived and/or modified sequence opt4 from hemagglutinin__InfluenzaA__AEO89300
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgccaacgaccugugcuaccccggcaacuucaacgacuacgaggagcugaagcaccugcugagcagaaucaaccacuucgagaagauccagaucauccccaagagcagcuggagcgaccacgaggccagcagcggcgugagcagcgccugccccuaccagggcacccccagcuucuucagaaacgugguguggcugaucaagaagaacaacaccuaccccaccaucaagagaagcuacaacaacaccaaccaggagaaccugcugauccuguggggcauccaccacagcaacgacgccgccgagcagaucaagcuguaccagcaccccaccaccuacaucagcgugggcaccagcacccugaaccagagacuggugcccaagaucgccaccagaagcaaggugaacggccagagcggcagaauggacuucuucuggaccauccugaagcccaacgacgccaucaacuucgagagcaacggcaacuucaucgcccccgaguacgccuacaagaucgugaaggagggcgacagcgccaucaugaagagcgagguggaguacggcaacugcaacaccaagugccagacccccaucggcgccaucaacagcagcaugcccuuccacaacauccacccccugaccaucggcgagugccccaaguacgugaagagcaacaagcuggugcuggccaccggccugagaaacagcccccugagagagagaagaagaaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucaacggcgugaagcuggagagcaugggcaccuaccagauccugagcaucuacagcaccguggccagcagccuggcccuggccaucaugguggccggccugagcuucuggaugugcagcaacggcagccugcagugcagaaucugcaucuga

SEQ ID NO: 160249 - RNA, 1704 nt, Artificial Sequence
  derived and/or modified sequence opt4 from hemagglutinin__InfluenzaA__AEO89311
auggagaagaucgugcugcuguucgccaucgugagccuggugaagagcgaccacaucugcaucggcuaccacgccaacaacagcaccgagcagguggacaccaucauggagaagaacgugaccgugacccacgcccaggacauccuggagaagacccacaacggcaagcugugcgaccugaacggcgugaagccccugauccugaaggacugcagcguggccggcuggcugcugggcaaccccaugugcgacgaguucaucaacgugcccgaguggagcuacaucguggagaaggccaaccccgccaacgaccugugcuaccccggcaacuucaacgacuacgaggagcugaagcaccugcugagcagaaucaaccacuucgagaagauccagaucauccccaaggacagcuggagcgaccacgaggccagccugggcgugagcgccgccugccccuaccagggcaacagcagcuucuucagaaacgugguguggcugaucaagaaggacaacgccuaccccaccaucaagaagagcuacaacaacaccaaccaggaggaccugcugauccuguggggcauccaccaccccaacgacgaggccgagcagaccagacuguaccagaaccccaccaccuacaucagcaucggcaccagcacccugaaccagagacuggugcccaagaucgccaccagaagcaaggugaacggccagagcggcagaaucgacuucuucuggaccauccugaagcccaacgacgccauccacuucgagagcaacggcaacuucaucgcccccgaguacgccuacaagaucgugaagaagggcgacagcaccaucaugaagagcgagguggaguacggcaacugcaacaccagaugccagacccccaugggcgccaucaacagcagcaugcccuuccacaacauccacccccugaccaucggcgagugccccaaguacgugaagagcaccaagcuggugcuggccaccggccugagaaacagcccccagagagagagaagaagaaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaagcuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcaacaacgagugcauggagagcgugagaaacggcaccuacgacuacccccaguacagcgaggaggccagacugaagagagaggagaucagcggcgugaagcuggagagcaucggcaucuaccagauccugagcaucuacagcaccguggccagcagccuggugcuggccaucaugauggccggccugagccuguggaugugcagcaacggcagccugcagugcagaaucugcaucuga

SEQ ID NO: 160250 - RNA, 1701 nt, Artificial Sequence; identical to SEQ ID NO: 154448
  derived and/or modified sequence opt4 from hemagglutinin__InfluenzaA__AEO99215

SEQ ID NO: 160251 - RNA, 1698 nt, Artificial Sequence
  derived and/or modified sequence opt4 from hemagglutinin__InfluenzaA__AEQ38187
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgccagcgccagcugcagccacaacggcgagaacagcuucuacagaaaccugcuguggcugaccggcaagaacggccuguaccccaaccugagcaagagcuacgccaacaacaaggagaaggaggugcuggugcuguggggcgugcaccacccccccaacaucgccgaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 160252 - RNA, 1698 nt, Artificial Sequence; identical to SEQ ID NO: 160251
  derived and/or modified sequence opt4 from hemagglutinin__InfluenzaA__AEQ38188

SEQ ID NO: 160253 - RNA, 1698 nt, Artificial Sequence
  derived and/or modified sequence opt4 from hemagglutinin__InfluenzaA__AEQ38189
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagaacagcuucuacagaaaccugcuguggcugaccggcaagaacggccuguaccccaaccugagcaagagcuacgccaacaacaaggagaaggaggugcuggugcuguggggcgugcaccacccccccaacaucgccaaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 160254 - RNA, 1698 nt, Artificial Sequence
  derived and/or modified sequence opt4 from hemagglutinin__InfluenzaA__AEQ38190
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagaacagcuucuacagaaaccugcuguggcugaccggcaagaacggccuguaccccaaccugagcaagcccuacgccaacaacaaggagaaggaggugcuggugcuguggggcgugcaccacccccccaacaucgccgugcagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 160255 - RNA, 1698 nt, Artificial Sequence; identical to SEQ ID NO: 156146
  derived and/or modified sequence opt4 from hemagglutinin__InfluenzaA__AEQ38191

SEQ ID NO: 160256 - RNA, 1698 nt, Artificial Sequence
  derived and/or modified sequence opt4 from hemagglutinin__InfluenzaA__AEQ38192
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccagcaucagcgaccagaagacccuguaccacaccgagaacgccuacgugagcguggugagcagccacuacagcagaaaguucacccccgagaucaccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacacccccauggacaagugcgacaccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 160257 - RNA, 1698 nt, Artificial Sequence
  derived and/or modified sequence opt4 from hemagglutinin__InfluenzaA__AEQ38193
augaaggugaagcugcugauccugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucguggaccagaagacccuguacagaaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 160258 - RNA, 1698 nt, Artificial Sequence
  derived and/or modified sequence opt4 from hemagglutinin__InfluenzaA__AEQ38194
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccagcaucagcgaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccagcggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccacagaaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagagaguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 160259 - RNA, 1698 nt, Artificial Sequence
  derived and/or modified sequence opt4 from hemagglutinin__InfluenzaA__AEQ38195
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgccagcgccagcugcagccacaacggcgagaacagcuucuacagaaaccugcuguggcugaccggcaagaacggccuguaccccaaccugagcaagagcuacgccaacaacaaggagaaggaggugcuggugcuguggggcgugcaccacccccccaacaucgccaaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccaugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 160260 - RNA, 1698 nt, Artificial Sequence
  derived and/or modified sequence opt4 from hemagglutinin__InfluenzaA__AEQ38196
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgccagcgccagcugcagccacaacggcgagaacagcuucuacagaaaccugcuguggcugaccggcaagaacggccuguaccccaaccugagcaagagcuacgccaacaacaaggagaaggaggugcuggugcuguggggcgugcaccacccccccaacaucgccgaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgaguaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 160261 - RNA, 1698 nt, Artificial Sequence; identical to SEQ ID NO: 160251
  derived and/or modified sequence opt4 from hemagglutinin__InfluenzaA__AEQ38197

SEQ ID NO: 160262 - RNA, 1698 nt, Artificial Sequence; identical to SEQ ID NO: 160251
  derived and/or modified sequence opt4 from hemagglutinin__InfluenzaA__AEQ38198

SEQ ID NO: 160263 - RNA, 1701 nt, Artificial Sequence; identical to SEQ ID NO: 159570
  derived and/or modified sequence opt4 from hemagglutinin__InfluenzaA__AEQ62909

SEQ ID NO: 160264 - RNA, 1701 nt, Artificial Sequence
  derived and/or modified sequence opt4 from hemagglutinin__InfluenzaA__AEQ62910
augaaggccauccugguggugaugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccgccagccccgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugauguggcuggugaagaagggcaacagcuaccccaagcugagcaagagcuacaucaacgacaagggcaaggaggugcuggugcuguggggcauccaccacccccccaccagcgccgaccagcagagccuguaccagaacgccgacgccuacguguucgugggcaccagcagauacagcaagaaguucaagcccgagaucgccaucagacccaaggugagaggccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagagccccaagggcgccaucaacaccagccugcccuuccagaacauccaccccaucaccaucggcgagugccccaaguacgugaagagcaccaagcugagacuggccaccggccugagaaacgugcccagcgugcagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccagcuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160265 - RNA, 1701 nt, Artificial Sequence; identical to SEQ ID NO: 159387
  derived and/or modified sequence opt4 from hemagglutinin__InfluenzaA__AEQ62911

SEQ ID NO: 160266 - RNA, 1701 nt, Artificial Sequence; identical to SEQ ID NO: 159570
  derived and/or modified sequence opt4 from hemagglutinin__InfluenzaA__AEQ62912

SEQ ID NO: 160267 - RNA, 1701 nt, Artificial Sequence
  derived and/or modified sequence opt4 from hemagglutinin__InfluenzaA__AEQ62915
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaccaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160268 - RNA, 1701 nt, Artificial Sequence; identical to SEQ ID NO: 155931
  derived and/or modified sequence opt4 from hemagglutinin__InfluenzaA__AER08646

SEQ ID NO: 160269 - RNA, 1701 nt, Artificial Sequence; identical to SEQ ID NO: 157939
  derived and/or modified sequence opt4 from hemagglutinin__InfluenzaA__AER08648

SEQ ID NO: 160270 - RNA, 1701 nt, Artificial Sequence
  derived and/or modified sequence opt4 from hemagglutinin__InfluenzaA__AER08652
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgccauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccagcgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160271 - RNA, 1701 nt, Artificial Sequence; identical to SEQ ID NO: 160270
  derived and/or modified sequence opt4 from hemagglutinin__InfluenzaA__AER08654

SEQ ID NO: 160272 - RNA, 1701 nt, Artificial Sequence
  derived and/or modified sequence opt4 from hemagglutinin__InfluenzaA__AER08656
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaugcagagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160273 - RNA, 1701 nt, Artificial Sequence
  derived and/or modified sequence opt4 from hemagglutinin__InfluenzaA__AER08660
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160274 - RNA, 1701 nt, Artificial Sequence
  derived and/or modified sequence opt4 from hemagglutinin__InfluenzaA__AER08664
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacagcgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160275 - RNA, 1701 nt, Artificial Sequence; identical to SEQ ID NO: 159502
  derived and/or modified sequence opt4 from hemagglutinin__InfluenzaA__AER08668

SEQ ID NO: 160276 - RNA, 1701 nt, Artificial Sequence
  derived and/or modified sequence opt4 from hemagglutinin__InfluenzaA__AER08670
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugaagagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160277 - RNA, 1701 nt, Artificial Sequence
  derived and/or modified sequence opt4 from hemagglutinin__InfluenzaA__AER08672
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcggcaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacagcgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160278 - RNA, 1701 nt, Artificial Sequence
  derived and/or modified sequence opt4 from hemagglutinin__InfluenzaA__AER08674
augaagaccaucaucgcccugagcuacauccugugccugguguucgcccagaagcugcccggcaacgacaacagcaccgccacccugugccugggccaccacgccgugcccaacggcaccauggugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160279 - RNA, 1701 nt, Artificial Sequence; identical to SEQ ID NO: 159502
  derived and/or modified sequence opt4 from hemagglutinin__InfluenzaA__AER08676

SEQ ID NO: 160280 - RNA, 1701 nt, Artificial Sequence; identical to SEQ ID NO: 159502
  derived and/or modified sequence opt4 from hemagglutinin__InfluenzaA__AER08678

SEQ ID NO: 160281 - RNA, 1701 nt, Artificial Sequence
  derived and/or modified sequence opt4 from hemagglutinin__InfluenzaA__AER08680
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcgccggcgagaucugcgacagcccccaccagauccuggacggcgagaacugcacccugaucgacgcccugcugggcgacccccagugcgacggcuuccagaacaagaagugggaccuguucguggagagaagcagagcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160282 - RNA, 1701 nt, Artificial Sequence
  derived and/or modified sequence opt4 from hemagglutinin__InfluenzaA__AER08682
augaagaccgugaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160283 - RNA, 1701 nt, Artificial Sequence
  derived and/or modified sequence opt4 from hemagglutinin__InfluenzaA__AER08684
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcaccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160284 - RNA, 1701 nt, Artificial Sequence
  derived and/or modified sequence opt4 from hemagglutinin__InfluenzaA__AER08686
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcaccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacaucgaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160285 - RNA, 1701 nt, Artificial Sequence; identical to SEQ ID NO: 159502
  derived and/or modified sequence opt4 from hemagglutinin__InfluenzaA__AER08688

SEQ ID NO: 160286 - RNA, 1701 nt, Artificial Sequence
  derived and/or modified sequence opt4 from hemagglutinin__InfluenzaA__AER08690
augaagaccaucaucgcccugagcuacauccugugccugguguucgcccagaagcugcccgagaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcaccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 160287 - RNA, 1701 nt, Artificial Sequence; identical to SEQ ID NO: 159502
  derived and/or modified sequence opt4 from hemagglutinin__InfluenzaA__AER08692

SEQ ID NO: 160288 - RNA, 1701 nt, Artificial Sequence
  derived and/or modified sequence opt4 from hemagglutinin__InfluenzaA__AER08698
augaagaccaccaucgcccugagccacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcgccggcgagaucugcgacagcccccaccagauccuggacggcgagaacugcacccugaucgacgcccugcugggcgacccccagugcgacggcuuccagaacaagaagugggaccuguucguggagagaagcagagccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160289 - RNA, 1701 nt, Artificial Sequence; identical to SEQ ID NO: 159502
  derived and/or modified sequence opt4 from hemagglutinin__InfluenzaA__AER08700

SEQ ID NO: 160290 - RNA, 1701 nt, Artificial Sequence
  derived and/or modified sequence opt4 from hemagglutinin__InfluenzaA__AER92712
augaaggccauccugguggugcugcuguacaccuucgccaccgccaacgccgacacccugugcaucggcuaccacgccaacaacagcaccgacaccguggacaccgugcuggagaagaacgugaccgugacccacagcguggaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcaacagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugaacaagagcuacaucaacgacaagggcaaggaggugcuggugcuguggggcauccaccaccccagcaccagcaccgaccagcagagccuguaccagaacgccgacgccuacguguucgugggcaccagcagauacagcaagaaguucaagcccgagaucgccaucagacccaaggugagaaaccaggagggcagaaugaacuacuacuggacccugguggagcccggcgacaagaucaccuucgaggccaccggcaaccugguggugcccagauacgccuucaccaucgagagaaacgccggcagcggcaucaucaucagcgacacccccauccacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160291 - RNA, 1701 nt, Artificial Sequence; identical to SEQ ID NO: 158053
  derived and/or modified sequence opt4 from hemagglutinin__InfluenzaA__AET10090

SEQ ID NO: 160292 - RNA, 1701 nt, Artificial Sequence; identical to SEQ ID NO: 158053
  derived and/or modified sequence opt4 from hemagglutinin__InfluenzaA__AET10091

SEQ ID NO: 160293 - RNA, 1701 nt, Artificial Sequence; identical to SEQ ID NO: 158053
  derived and/or modified sequence opt4 from hemagglutinin__InfluenzaA__AET10092

SEQ ID NO: 160294 - RNA, 1701 nt, Artificial Sequence
  derived and/or modified sequence opt4 from hemagglutinin__InfluenzaA__AET10094
augaagaccaucaucgcccugagcugcauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcagcugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaccaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160295 - RNA, 1701 nt, Artificial Sequence
  derived and/or modified sequence opt4 from hemagglutinin__InfluenzaA__AET10095
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacacccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucgagagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160296 - RNA, 1701 nt, Artificial Sequence
  derived and/or modified sequence opt4 from hemagglutinin__InfluenzaA__AET10096
augaagaccaucaucgcccugagcuacauccugugccugguguucgcccagaaguuccccggcaacgacaacagcaccgccacccugugccugggccaccacgccgugcccaacggcaccaucgugaagaccaucaccaacgaccagaucgaggugaccaacgccaccgagcuggugcagaacagcagcaccggcgagaucugcgacagcccccaccagaucaucgacggcgagaacugcacccugaucgacgcccugcugggcgacccccagugcgacggcuuccagaacaagaaguggaaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160297 - RNA, 1701 nt, Artificial Sequence
  derived and/or modified sequence opt4 from hemagglutinin__InfluenzaA__AET10098
augaagaccaucaucgcccugagcuacauccugugccugguguucgcccagaaguuccccggcaacgacaacagcaccgccacccugugccugggccaccacgccgugcccaacggcaccaucgugaagaccaucaccaacgaccagaucgaggugaccaacgccaccgagcuggugcagaacagcagcaccggcgagaucugcgacagcccccaccagaucaucgacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160298 - RNA, 1701 nt, Artificial Sequence; identical to SEQ ID NO: 159375
  derived and/or modified sequence opt4 from hemagglutinin__InfluenzaA__AET10099

SEQ ID NO: 160299 - RNA, 1701 nt, Artificial Sequence; identical to SEQ ID NO: 159502
  derived and/or modified sequence opt4 from hemagglutinin__InfluenzaA__AET10100

SEQ ID NO: 160300 - RNA, 1701 nt, Artificial Sequence
  derived and/or modified sequence opt4 from hemagglutinin__InfluenzaA__AET10101
augaagaccaucaucgcccugagcugcauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcgccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaccaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160301 - RNA, 1701 nt, Artificial Sequence
  derived and/or modified sequence opt4 from hemagglutinin__InfluenzaA__AET10102
augaagaccaucaucgcccugagcuacauccugugccugguguucacccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuucgacgugcccgacuacgccagccugagaagccugguggccagcagcggcacccuggaguucaacaacgagagcuucaacuggaccggcgugacccagaacggcaccagcagcgccugcaugagaagaagcaagagcagcuucuucagcagacugaacuggcugacccaccugaacuucaaguaccccgcccugaacgugaccaugcccaacgacgagcaguucgacaagcuguacaucuggggcgugcaccaccccggcaccgacaaggaccagaucuuccuguacgcccaggccagcggcagaaucaccgugagcaccaagagaagccagcagaccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcagaaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggccagccugggcuucaucaugugggccugccagaagggcaacaucagaugcaacaucugcaucuga

SEQ ID NO: 160302 - RNA, 1701 nt, Artificial Sequence
  derived and/or modified sequence opt4 from hemagglutinin__InfluenzaA__AET10103
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160303 - RNA, 1701 nt, Artificial Sequence
  derived and/or modified sequence opt4 from hemagglutinin__InfluenzaA__AET10104
augaagaccaucaucgcccugagcuacauccugugccugguguucgcccagaaguuccccggcaacgacaacagcaccgccacccugugccugggccaccacgccgugcccaacggcaccaucgugaagaccaucaccaacgaccagaucgaggugaccaacgccaccgagcuggugcagaacagcagcaccggcgagaucugcgacagcccccaccagaucaucgacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccugggcaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160304 - RNA, 1701 nt, Artificial Sequence
  derived and/or modified sequence opt4 from hemagglutinin__InfluenzaA__AET10105
augaagaccaucaucgcccugagcuacauccugugccugguguucgcccaggagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccgccggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160305 - RNA, 1701 nt, Artificial Sequence
  derived and/or modified sequence opt4 from hemagglutinin__InfluenzaA__AET10106
augaagaccaucaucgcccugagcuacauccugugccugguguucgcccagaagcugcccggcaacuacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160306 - RNA, 1701 nt, Artificial Sequence
  derived and/or modified sequence opt4 from hemagglutinin__InfluenzaA__AET10107
augaagaccaucaucgcccugagcuacauccugugccugguguucgcccaggagauccccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucaagugcaacaucugcaucuga

SEQ ID NO: 160307 - RNA, 1701 nt, Artificial Sequence; identical to SEQ ID NO: 155931
  derived and/or modified sequence opt4 from hemagglutinin__InfluenzaA__AET10108

SEQ ID NO: 160308 - RNA, 1701 nt, Artificial Sequence; identical to SEQ ID NO: 159502
  derived and/or modified sequence opt4 from hemagglutinin__InfluenzaA__AET10109

SEQ ID NO: 160309 - RNA, 1701 nt, Artificial Sequence
  derived and/or modified sequence opt4 from hemagglutinin__InfluenzaA__AET10110
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucaagugcaacaucugcaucuga

SEQ ID NO: 160310 - RNA, 1701 nt, Artificial Sequence
  derived and/or modified sequence opt4 from hemagglutinin__InfluenzaA__AET10111
augaagaccaucaucgcccugagcuacauccugugccugguguucgcccaggagauccccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugagcaacagcaccggcaaccugaucggccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160311 - RNA, 1701 nt, Artificial Sequence
  derived and/or modified sequence opt4 from hemagglutinin__InfluenzaA__AET10113
augaagaccaucaucgcccugagcuacauccugugccugguguucgcccaggagcugcccggcaacgacaacagcaccgccacccugugccugggccaccacgccgugcagaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160312 - RNA, 1701 nt, Artificial Sequence
  derived and/or modified sequence opt4 from hemagglutinin__InfluenzaA__AET10114
augaagaccaucaucgcccugagcuacauccugugccugguguucgcccaggagcugcccggcaacgacgacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcaucagcaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucaugugcaacaucugcaucuga

SEQ ID NO: 160313 - RNA, 1698 nt, Artificial Sequence
  derived and/or modified sequence opt4 from hemagglutinin__InfluenzaA__AET50439
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcaaccagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 160314 - RNA, 1698 nt, Artificial Sequence
  derived and/or modified sequence opt4 from hemagglutinin__InfluenzaA__AET50440
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccacccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcaaccagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 160315 - RNA, 1698 nt, Artificial Sequence
  derived and/or modified sequence opt4 from hemagglutinin__InfluenzaA__AET50441
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccacccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcaaccagaaggcccuguaccacaccgagaacgccuacgugagcguggugagcagccacuacagcagaaaguucacccccgagaucgccaagagacccaaggugagaggccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 160316 - RNA, 1698 nt, Artificial Sequence
  derived and/or modified sequence opt4 from hemagglutinin__InfluenzaA__AET50442
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaucugcuaccccggccacuucgccgacuacgaggagcugagagagcagcugagcagcgugagcagcuucgagagauucgagaucuuccccaaggagagcagcuggcccacccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcaaccagaaggcccuguaccacaccgagaacgccuacgugagcguggugagcagccacuacagcagaaaguucacccccgagaucgccaagagacccaaggugagaggccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 160317 - RNA, 1698 nt, Artificial Sequence
  derived and/or modified sequence opt4 from hemagglutinin__InfluenzaA__AET84163
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagagccugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccagcaucagcaaccagaagacccuguaccacaccgagaacgccuacgugagcguggugagcagccacuacagcagaaaguucacccccgagguggccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 160318 - RNA, 1698 nt, Artificial Sequence
  derived and/or modified sequence opt4 from hemagglutinin__InfluenzaA__AET84174
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucguggaccagaagacccuguacagaaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugaucagaggcuucggcagcggcaucaucaacagcaacgcccccaugggcaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 160319 - RNA, 1698 nt, Artificial Sequence
  derived and/or modified sequence opt4 from hemagglutinin__InfluenzaA__AET84196
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagagccugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccagaaagaacggccuguaccccacccugagcaagagcuacgccaacaacaaggagaaggaggugcuggugcuguggggcgugcaccacccccccagcaucaacgaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcagcgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacaacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 160320 - RNA, 1698 nt, Artificial Sequence
  derived and/or modified sequence opt4 from hemagglutinin__InfluenzaA__AET84207
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugcccagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccagcaucaacgaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccagagacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 160321 - RNA, 1698 nt, Artificial Sequence
  derived and/or modified sequence opt4 from hemagglutinin__InfluenzaA__AET84218
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucagcaaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccagcggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 160322 - RNA, 1698 nt, Artificial Sequence
  derived and/or modified sequence opt4 from hemagglutinin__InfluenzaA__AET84229
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccacccugagcaagagcuacgccaacaacaaggagaaggaggugcuggugcuguggggcgugcaccacccccccaacaucguggaccagaagacccuguacagaaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccaugggcaagugcgacgccaagugccagaccccccagggcgccaucaacagcagccugcccuuccagaacgugcaccccgugaccaucggcgagugccccaaguacgugagaagcgccaagcugagaauggugaccggccugagaaacaucccccccauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 160323 - RNA, 1698 nt, Artificial Sequence
  derived and/or modified sequence opt4 from hemagglutinin__InfluenzaA__AET84240
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucguggaccagaagacccuguacagaaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccaugggcaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 160324 - RNA, 1698 nt, Artificial Sequence
  derived and/or modified sequence opt4 from hemagglutinin__InfluenzaA__AET84251
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucgugaaccagaagacccuguacagaaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccaugggcaagugcgacgccaagugccagaccccccacggcgccaucaacagcugccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacaaggagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 160325 - RNA, 1698 nt, Artificial Sequence
  derived and/or modified sequence opt4 from hemagglutinin__InfluenzaA__AET84262
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucguggaccagaagacccuguacagaaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccacggcgccaucaacagcugccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 160326 - RNA, 1698 nt, Artificial Sequence; identical to SEQ ID NO: 160253
  derived and/or modified sequence opt4 from hemagglutinin__InfluenzaA__AET84284

SEQ ID NO: 160327 - RNA, 1698 nt, Artificial Sequence
  derived and/or modified sequence opt4 from hemagglutinin__InfluenzaA__AET84306
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcaaccagaaggcccuguaccacaccgagaacgccuacgugagcguggugagcagccacuacagcaucaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 160328 - RNA, 1698 nt, Artificial Sequence
  derived and/or modified sequence opt4 from hemagglutinin__InfluenzaA__AET84339
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagaagcuucuacagaaaccugcuguggcugaccggcaagaacggccuguaccccaaccugagcaagagcuacgccaacaacaaggagaaggaggugcuggugcuguggggcgugcaccacccccccaacaucggcaaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 160329 - RNA, 1698 nt, Artificial Sequence; identical to SEQ ID NO: 160328
  derived and/or modified sequence opt4 from hemagglutinin__InfluenzaA__AET84361

SEQ ID NO: 160330 - RNA, 1698 nt, Artificial Sequence
  derived and/or modified sequence opt4 from hemagglutinin__InfluenzaA__AET84372
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagaagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 160331 - RNA, 1698 nt, Artificial Sequence
  derived and/or modified sequence opt4 from hemagglutinin__InfluenzaA__AET84394
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagaagcuucuacagaaaccugcuguggcugaccggcaagaacggccuguaccccaaccugagcaagagcuacgccaacaacaaggagaaggaggugcuggugcuguggggcgugcaccacccccccgacaucggcaaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgagaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 160332 - RNA, 1698 nt, Artificial Sequence; identical to SEQ ID NO: 158036
  derived and/or modified sequence opt4 from hemagglutinin__InfluenzaA__AET84405

SEQ ID NO: 160333 - RNA, 1698 nt, Artificial Sequence
  derived and/or modified sequence opt4 from hemagglutinin__InfluenzaA__AET84416
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagaagcuucuacagaaaccugcuguggcugaccggcaagaacggccuguaccccacccugagcaagagcuacgccaacaacaaggagaaggaggugcuggugcuguggggcgugcaccacccccccgacaucggcgaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 160334 - RNA, 1698 nt, Artificial Sequence
  derived and/or modified sequence opt4 from hemagglutinin__InfluenzaA__AET84427
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcaaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 160335 - RNA, 1698 nt, Artificial Sequence
  derived and/or modified sequence opt4 from hemagglutinin__InfluenzaA__AET84438
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgugcagaagacccuguacaacaccgagaacgccuacgugagcguggugagcagccacuacagcagaaaguucacccccgagaucgccaagagacccaaggugagagaccaggagggcagaaucaacuacuacuggacccugcuggagcccggcgacaccaucauguucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 160336 - RNA, 1698 nt, Artificial Sequence
  derived and/or modified sequence opt4 from hemagglutinin__InfluenzaA__AET84449
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcagagagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccaccaccggcgugagcgccagcugcagccacaacggcgagagcagcuucuacaagaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacggcugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 160337 - RNA, 1701 nt, Artificial Sequence
  derived and/or modified sequence opt4 from hemagglutinin__InfluenzaA__AET98600
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccgugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaccaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160338 - RNA, 1701 nt, Artificial Sequence
  derived and/or modified sequence opt4 from hemagglutinin__InfluenzaA__AEV76874
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagcuucagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaaccccgagaucgagaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160339 - RNA, 1701 nt, Artificial Sequence; identical to SEQ ID NO: 155189
  derived and/or modified sequence opt4 from hemagglutinin__InfluenzaA__AEW10574

SEQ ID NO: 160340 - RNA, 1701 nt, Artificial Sequence; identical to SEQ ID NO: 155189
  derived and/or modified sequence opt4 from hemagglutinin__InfluenzaA__AEW10584

SEQ ID NO: 160341 - RNA, 1701 nt, Artificial Sequence; identical to SEQ ID NO: 155542
  derived and/or modified sequence opt4 from hemagglutinin__InfluenzaA__AEW10594

SEQ ID NO: 160342 - RNA, 1701 nt, Artificial Sequence; identical to SEQ ID NO: 155542
  derived and/or modified sequence opt4 from hemagglutinin__InfluenzaA__AEW10604

SEQ ID NO: 160343 - RNA, 1701 nt, Artificial Sequence; identical to SEQ ID NO: 155542
  derived and/or modified sequence opt4 from hemagglutinin__InfluenzaA__AEW10614

SEQ ID NO: 160344 - RNA, 1701 nt, Artificial Sequence; identical to SEQ ID NO: 155542
  derived and/or modified sequence opt4 from hemagglutinin__InfluenzaA__AEW10624

SEQ ID NO: 160345 - RNA, 1701 nt, Artificial Sequence; identical to SEQ ID NO: 155189
  derived and/or modified sequence opt4 from hemagglutinin__InfluenzaA__AEW10634

SEQ ID NO: 160346 - RNA, 1701 nt, Artificial Sequence; identical to SEQ ID NO: 155176
  derived and/or modified sequence opt4 from hemagglutinin__InfluenzaA__AEW10644

SEQ ID NO: 160347 - RNA, 1701 nt, Artificial Sequence
  derived and/or modified sequence opt4 from hemagglutinin__InfluenzaA__AEW10654
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugaacaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160348 - RNA, 1701 nt, Artificial Sequence; identical to SEQ ID NO: 155176
  derived and/or modified sequence opt4 from hemagglutinin__InfluenzaA__AEW10664

SEQ ID NO: 160349 - RNA, 1701 nt, Artificial Sequence
  derived and/or modified sequence opt4 from hemagglutinin__InfluenzaA__AEW10674
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccgaggccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160350 - RNA, 1701 nt, Artificial Sequence; identical to SEQ ID NO: 155189
  derived and/or modified sequence opt4 from hemagglutinin__InfluenzaA__AEW10684

SEQ ID NO: 160351 - RNA, 1701 nt, Artificial Sequence; identical to SEQ ID NO: 155176
  derived and/or modified sequence opt4 from hemagglutinin__InfluenzaA__AEW10694

SEQ ID NO: 160352 - RNA, 1701 nt, Artificial Sequence; identical to SEQ ID NO: 155176
  derived and/or modified sequence opt4 from hemagglutinin__InfluenzaA__AEW10704

SEQ ID NO: 160353 - RNA, 1701 nt, Artificial Sequence; identical to SEQ ID NO: 160347
  derived and/or modified sequence opt4 from hemagglutinin__InfluenzaA__AEW10724

SEQ ID NO: 160354 - RNA, 1701 nt, Artificial Sequence; identical to SEQ ID NO: 155189
  derived and/or modified sequence opt4 from hemagglutinin__InfluenzaA__AEW10734

SEQ ID NO: 160355 - RNA, 1701 nt, Artificial Sequence
  derived and/or modified sequence opt4 from hemagglutinin__InfluenzaA__AEW10744
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccugagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160356 - RNA, 1701 nt, Artificial Sequence; identical to SEQ ID NO: 160355
  derived and/or modified sequence opt4 from hemagglutinin__InfluenzaA__AEW10754

SEQ ID NO: 160357 - RNA, 1701 nt, Artificial Sequence
  derived and/or modified sequence opt4 from hemagglutinin__InfluenzaA__AEW10764
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccaacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160358 - RNA, 1701 nt, Artificial Sequence; identical to SEQ ID NO: 155433
  derived and/or modified sequence opt4 from hemagglutinin__InfluenzaA__AEW10774

SEQ ID NO: 160359 - RNA, 1701 nt, Artificial Sequence; identical to SEQ ID NO: 155176
  derived and/or modified sequence opt4 from hemagglutinin__InfluenzaA__AEW10784

SEQ ID NO: 160360 - RNA, 1701 nt, Artificial Sequence; identical to SEQ ID NO: 155176
  derived and/or modified sequence opt4 from hemagglutinin__InfluenzaA__AEW10794

SEQ ID NO: 160361 - RNA, 1701 nt, Artificial Sequence; identical to SEQ ID NO: 155369
  derived and/or modified sequence opt4 from hemagglutinin__InfluenzaA__AEW10804

SEQ ID NO: 160362 - RNA, 1701 nt, Artificial Sequence; identical to SEQ ID NO: 155187
  derived and/or modified sequence opt4 from hemagglutinin__InfluenzaA__AEW10814

SEQ ID NO: 160363 - RNA, 1701 nt, Artificial Sequence; identical to SEQ ID NO: 155280
  derived and/or modified sequence opt4 from hemagglutinin__InfluenzaA__AEW10824

SEQ ID NO: 160364 - RNA, 1701 nt, Artificial Sequence; identical to SEQ ID NO: 155176
  derived and/or modified sequence opt4 from hemagglutinin__InfluenzaA__AEW10834

SEQ ID NO: 160365 - RNA, 1701 nt, Artificial Sequence; identical to SEQ ID NO: 155369
  derived and/or modified sequence opt4 from hemagglutinin__InfluenzaA__AEW10844

SEQ ID NO: 160366 - RNA, 1701 nt, Artificial Sequence
  derived and/or modified sequence opt4 from hemagglutinin__InfluenzaA__AEW10854
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucaccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160367 - RNA, 1701 nt, Artificial Sequence; identical to SEQ ID NO: 155369
  derived and/or modified sequence opt4 from hemagglutinin__InfluenzaA__AEW10864

SEQ ID NO: 160368 - RNA, 1701 nt, Artificial Sequence; identical to SEQ ID NO: 155369
  derived and/or modified sequence opt4 from hemagglutinin__InfluenzaA__AEW10874

SEQ ID NO: 160369 - RNA, 1701 nt, Artificial Sequence; identical to SEQ ID NO: 155369
  derived and/or modified sequence opt4 from hemagglutinin__InfluenzaA__AEW10884

SEQ ID NO: 160370 - RNA, 1701 nt, Artificial Sequence; identical to SEQ ID NO: 155176
  derived and/or modified sequence opt4 from hemagglutinin__InfluenzaA__AEW10894

SEQ ID NO: 160371 - RNA, 1701 nt, Artificial Sequence; identical to SEQ ID NO: 155369
  derived and/or modified sequence opt4 from hemagglutinin__InfluenzaA__AEW10904

SEQ ID NO: 160372 - RNA, 1701 nt, Artificial Sequence; identical to SEQ ID NO: 155369
  derived and/or modified sequence opt4 from hemagglutinin__InfluenzaA__AEW10914

SEQ ID NO: 160373 - RNA, 1701 nt, Artificial Sequence; identical to SEQ ID NO: 155176
  derived and/or modified sequence opt4 from hemagglutinin__InfluenzaA__AEW10924

SEQ ID NO: 160374 - RNA, 1701 nt, Artificial Sequence; identical to SEQ ID NO: 155176
  derived and/or modified sequence opt4 from hemagglutinin__InfluenzaA__AEW10934

SEQ ID NO: 160375 - RNA, 1701 nt, Artificial Sequence; identical to SEQ ID NO: 155369
  derived and/or modified sequence opt4 from hemagglutinin__InfluenzaA__AEW10944

SEQ ID NO: 160376 - RNA, 1701 nt, Artificial Sequence; identical to SEQ ID NO: 155189
  derived and/or modified sequence opt4 from hemagglutinin__InfluenzaA__AEW10954

SEQ ID NO: 160377 - RNA, 1701 nt, Artificial Sequence; identical to SEQ ID NO: 155189
  derived and/or modified sequence opt4 from hemagglutinin__InfluenzaA__AEW10964

SEQ ID NO: 160378 - RNA, 1701 nt, Artificial Sequence; identical to SEQ ID NO: 155369
  derived and/or modified sequence opt4 from hemagglutinin__InfluenzaA__AEW10974

SEQ ID NO: 160379 - RNA, 1701 nt, Artificial Sequence; identical to SEQ ID NO: 155189
  derived and/or modified sequence opt4 from hemagglutinin__InfluenzaA__AEW10984

SEQ ID NO: 160380 - RNA, 1701 nt, Artificial Sequence; identical to SEQ ID NO: 155189
  derived and/or modified sequence opt4 from hemagglutinin__InfluenzaA__AEW10994

SEQ ID NO: 160381 - RNA, 1701 nt, Artificial Sequence; identical to SEQ ID NO: 155189
  derived and/or modified sequence opt4 from hemagglutinin__InfluenzaA__AEW11004

SEQ ID NO: 160382 - RNA, 1701 nt, Artificial Sequence; identical to SEQ ID NO: 155189
  derived and/or modified sequence opt4 from hemagglutinin__InfluenzaA__AEW11014

SEQ ID NO: 160383 - RNA, 1701 nt, Artificial Sequence; identical to SEQ ID NO: 155189
  derived and/or modified sequence opt4 from hemagglutinin__InfluenzaA__AEW11024

SEQ ID NO: 160384 - RNA, 1701 nt, Artificial Sequence; identical to SEQ ID NO: 155189
  derived and/or modified sequence opt4 from hemagglutinin__InfluenzaA__AEW11034

SEQ ID NO: 160385 - RNA, 1701 nt, Artificial Sequence; identical to SEQ ID NO: 155369
  derived and/or modified sequence opt4 from hemagglutinin__InfluenzaA__AEW11044

SEQ ID NO: 160386 - RNA, 1701 nt, Artificial Sequence; identical to SEQ ID NO: 155189
  derived and/or modified sequence opt4 from hemagglutinin__InfluenzaA__AEW11054

SEQ ID NO: 160387 - RNA, 1701 nt, Artificial Sequence; identical to SEQ ID NO: 155176
  derived and/or modified sequence opt4 from hemagglutinin__InfluenzaA__AEW11064

SEQ ID NO: 160388 - RNA, 1701 nt, Artificial Sequence; identical to SEQ ID NO: 155176
  derived and/or modified sequence opt4 from hemagglutinin__InfluenzaA__AEW11074

SEQ ID NO: 160389 - RNA, 1701 nt, Artificial Sequence
  derived and/or modified sequence opt4 from hemagglutinin__InfluenzaA__AEW11084
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugccugcacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160390 - RNA, 1701 nt, Artificial Sequence; identical to SEQ ID NO: 155176
  derived and/or modified sequence opt4 from hemagglutinin__InfluenzaA__AEW11094

SEQ ID NO: 160391 - RNA, 1701 nt, Artificial Sequence; identical to SEQ ID NO: 155176
  derived and/or modified sequence opt4 from hemagglutinin__InfluenzaA__AEW11104

SEQ ID NO: 160392 - RNA, 1701 nt, Artificial Sequence; identical to SEQ ID NO: 155189
  derived and/or modified sequence opt4 from hemagglutinin__InfluenzaA__AEW11114

SEQ ID NO: 160393 - RNA, 1701 nt, Artificial Sequence
  derived and/or modified sequence opt4 from hemagglutinin__InfluenzaA__AEW11124
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguucgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160394 - RNA, 1701 nt, Artificial Sequence
  derived and/or modified sequence opt4 from hemagglutinin__InfluenzaA__AEW11134
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacaaggaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160395 - RNA, 1701 nt, Artificial Sequence; identical to SEQ ID NO: 155189
  derived and/or modified sequence opt4 from hemagglutinin__InfluenzaA__AEW11144

SEQ ID NO: 160396 - RNA, 1701 nt, Artificial Sequence; identical to SEQ ID NO: 155189
  derived and/or modified sequence opt4 from hemagglutinin__InfluenzaA__AEW11154

SEQ ID NO: 160397 - RNA, 1701 nt, Artificial Sequence; identical to SEQ ID NO: 160389
  derived and/or modified sequence opt4 from hemagglutinin__InfluenzaA__AEW11164

SEQ ID NO: 160398 - RNA, 1701 nt, Artificial Sequence; identical to SEQ ID NO: 160389
  derived and/or modified sequence opt4 from hemagglutinin__InfluenzaA__AEW11174

SEQ ID NO: 160399 - RNA, 1701 nt, Artificial Sequence; identical to SEQ ID NO: 155189
  derived and/or modified sequence opt4 from hemagglutinin__InfluenzaA__AEW11184

SEQ ID NO: 160400 - RNA, 1701 nt, Artificial Sequence; identical to SEQ ID NO: 155176
  derived and/or modified sequence opt4 from hemagglutinin__InfluenzaA__AEW11194

SEQ ID NO: 160401 - RNA, 1701 nt, Artificial Sequence; identical to SEQ ID NO: 155189
  derived and/or modified sequence opt4 from hemagglutinin__InfluenzaA__AEW11204

SEQ ID NO: 160402 - RNA, 1701 nt, Artificial Sequence; identical to SEQ ID NO: 155189
  derived and/or modified sequence opt4 from hemagglutinin__InfluenzaA__AEW11214

SEQ ID NO: 160403 - RNA, 1701 nt, Artificial Sequence; identical to SEQ ID NO: 155369
  derived and/or modified sequence opt4 from hemagglutinin__InfluenzaA__AEW11224

SEQ ID NO: 160404 - RNA, 1701 nt, Artificial Sequence; identical to SEQ ID NO: 155189
  derived and/or modified sequence opt4 from hemagglutinin__InfluenzaA__AEW11234

SEQ ID NO: 160405 - RNA, 1701 nt, Artificial Sequence; identical to SEQ ID NO: 155189
  derived and/or modified sequence opt4 from hemagglutinin__InfluenzaA__AEW11244

SEQ ID NO: 160406 - RNA, 1701 nt, Artificial Sequence
  derived and/or modified sequence opt4 from hemagglutinin__InfluenzaA__AEW11254
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugccugcacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcgccagcgccgaccagcagagccuguaccagaacgccgacgccuacguguucgugggcagcagcagauacagcaagaaggugaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160407 - RNA, 1701 nt, Artificial Sequence; identical to SEQ ID NO: 155176
  derived and/or modified sequence opt4 from hemagglutinin__InfluenzaA__AEW11263

SEQ ID NO: 160408 - RNA, 1701 nt, Artificial Sequence; identical to SEQ ID NO: 155176
  derived and/or modified sequence opt4 from hemagglutinin__InfluenzaA__AEW11273

SEQ ID NO: 160409 - RNA, 1701 nt, Artificial Sequence; identical to SEQ ID NO: 155176
  derived and/or modified sequence opt4 from hemagglutinin__InfluenzaA__AEW11283

SEQ ID NO: 160410 - RNA, 1701 nt, Artificial Sequence; identical to SEQ ID NO: 155176
  derived and/or modified sequence opt4 from hemagglutinin__InfluenzaA__AEW11293

SEQ ID NO: 160411 - RNA, 1701 nt, Artificial Sequence
  derived and/or modified sequence opt4 from hemagglutinin__InfluenzaA__AEW11303
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccaccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagagugugcaucuga

SEQ ID NO: 160412 - RNA, 1701 nt, Artificial Sequence; identical to SEQ ID NO: 155176
  derived and/or modified sequence opt4 from hemagglutinin__InfluenzaA__AEW11313

SEQ ID NO: 160413 - RNA, 1701 nt, Artificial Sequence
  derived and/or modified sequence opt4 from hemagglutinin__InfluenzaA__AEW11323
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagaggccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccgugaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160414 - RNA, 1701 nt, Artificial Sequence
  derived and/or modified sequence opt4 from hemagglutinin__InfluenzaA__AEW22712
augaaggccauccugguggugcugcuguacaccuucgccaccgccaacgccgacacccugugcaucggcuaccacgccaacaacagcaccgacaccaucgacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccuggugaagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160415 - RNA, 1701 nt, Artificial Sequence
  derived and/or modified sequence opt4 from hemagglutinin__InfluenzaA__AEW22718
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccuggugaagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160416 - RNA, 1701 nt, Artificial Sequence; identical to SEQ ID NO: 158974
  derived and/or modified sequence opt4 from hemagglutinin__InfluenzaA__AEW22720

SEQ ID NO: 160417 - RNA, 1701 nt, Artificial Sequence; identical to SEQ ID NO: 158974
  derived and/or modified sequence opt4 from hemagglutinin__InfluenzaA__AEW22722

SEQ ID NO: 160418 - RNA, 1701 nt, Artificial Sequence
  derived and/or modified sequence opt4 from hemagglutinin__InfluenzaA__AEW22724
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccagagagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160419 - RNA, 1701 nt, Artificial Sequence
  derived and/or modified sequence opt4 from hemagglutinin__InfluenzaA__AEW25297
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccccggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgaccccaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccagaggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160420 - RNA, 1701 nt, Artificial Sequence; identical to SEQ ID NO: 155987
  derived and/or modified sequence opt4 from hemagglutinin__InfluenzaA__AEW25306

SEQ ID NO: 160421 - RNA, 1701 nt, Artificial Sequence
  derived and/or modified sequence opt4 from hemagglutinin__InfluenzaA__AEW25315
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgaccccaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucugggugugcagcaacggcagccugcagugcagaaucugcaucuga

SEQ ID NO: 160422 - RNA, 1701 nt, Artificial Sequence
  derived and/or modified sequence opt4 from hemagglutinin__InfluenzaA__AEW25331
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagcuucagcaccagcagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacaucccccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160423 - RNA, 1701 nt, Artificial Sequence
  derived and/or modified sequence opt4 from hemagglutinin__InfluenzaA__AEW25349
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagcuucagcaccagcagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160424 - RNA, 1701 nt, Artificial Sequence
  derived and/or modified sequence opt4 from hemagglutinin__InfluenzaA__AEW25367
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagcuucagcaccagcagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagacuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacaccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160425 - RNA, 1701 nt, Artificial Sequence
  derived and/or modified sequence opt4 from hemagglutinin__InfluenzaA__AEW25377
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccaccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugaagagccagcugaagaacaacgccaaggagaucggcaacggcugcuucgaguucuaccacaagugcgacaacgccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160426 - RNA, 1701 nt, Artificial Sequence
  derived and/or modified sequence opt4 from hemagglutinin__InfluenzaA__AEW25385
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugcccagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160427 - RNA, 1701 nt, Artificial Sequence; identical to SEQ ID NO: 160423
  derived and/or modified sequence opt4 from hemagglutinin__InfluenzaA__AEW25416

SEQ ID NO: 160428 - RNA, 1701 nt, Artificial Sequence
  derived and/or modified sequence opt4 from hemagglutinin__InfluenzaA__AEW25446
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgaccccaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacaagcaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160429 - RNA, 1701 nt, Artificial Sequence; identical to SEQ ID NO: 160423
  derived and/or modified sequence opt4 from hemagglutinin__InfluenzaA__AEW25454

SEQ ID NO: 160430 - RNA, 1701 nt, Artificial Sequence
  derived and/or modified sequence opt4 from hemagglutinin__InfluenzaA__AEW25462
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgaccccaacaagggcgugaccgccgccugcccccacgccggcgccaagagcuucuacaagaaccugaucuggcuggugaagaagggcaacagcuaccccaagcugagcaagcccuacaccaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160431 - RNA, 1701 nt, Artificial Sequence; identical to SEQ ID NO: 155987
  derived and/or modified sequence opt4 from hemagglutinin__InfluenzaA__AEW25472

SEQ ID NO: 160432 - RNA, 1701 nt, Artificial Sequence
  derived and/or modified sequence opt4 from hemagglutinin__InfluenzaA__AEW25482
augaaggccauccugguggugcugcuguacaccuucgccaccgccaacgccgacacccugugcaucggcuaccacgccaacaacagcaccgacaccguggacaccgugcuggagaagaaggugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcaacagcgacaacggcaccugcuaccccggcgacuucaucgacuacgaggagcugagagagcagcugagcagcgugagcagcuucgagagauucgagaucuuccccaagaccagcagcuggcccaaccacgaccccaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccagggcggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgagcuguaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160433 - RNA, 1701 nt, Artificial Sequence
  derived and/or modified sequence opt4 from hemagglutinin__InfluenzaA__AEW25492
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgaccccaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacaucuucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160434 - RNA, 1701 nt, Artificial Sequence
  derived and/or modified sequence opt4 from hemagglutinin__InfluenzaA__AEW25501
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagaaguucgagaucuuccccaagaccagcagcuggcccaaccacgacagcaacaagggcgugaccgccgccugcccccacgccggcgccaagagcuucuacaagaaccugaucugccuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160435 - RNA, 1701 nt, Artificial Sequence; identical to SEQ ID NO: 160423
  derived and/or modified sequence opt4 from hemagglutinin__InfluenzaA__AEW25509

SEQ ID NO: 160436 - RNA, 1701 nt, Artificial Sequence
  derived and/or modified sequence opt4 from hemagglutinin__InfluenzaA__AEW25519
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgaccccaacaagggcgugaccgccgccugcccccacaccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160437 - RNA, 1701 nt, Artificial Sequence
  derived and/or modified sequence opt4 from hemagglutinin__InfluenzaA__AEW25528
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagcuucagcaccagcagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagagaagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160438 - RNA, 1701 nt, Artificial Sequence
  derived and/or modified sequence opt4 from hemagglutinin__InfluenzaA__AEW25545
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgaccccaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcagcuacgacuaccccaaguacagcgaggaggccaagcugaacagagaggagaucgacggcgugaagcuggagagcaccagaaucuaccagauccuggccaucuacagcaccguggccagcagccuggugaugguggugagccugggcgccaucagcuucuggaugugcagcaacggcagccugcagugcagaaucugcaucuga

SEQ ID NO: 160439 - RNA, 1701 nt, Artificial Sequence
  derived and/or modified sequence opt4 from hemagglutinin__InfluenzaA__AEW25555
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgaccccaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacuacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160440 - RNA, 1701 nt, Artificial Sequence
  derived and/or modified sequence opt4 from hemagglutinin__InfluenzaA__AEW25564
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgcccugaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacagaaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccggcaucuaccagauccuggccaucuacagcaccguggccagcagccuggugcugguggugagccugggcgccaucagcuucuggaugugcagcaacggcagccugcagugcagaaucugcaucuga

SEQ ID NO: 160441 - RNA, 1701 nt, Artificial Sequence; identical to SEQ ID NO: 155987
  derived and/or modified sequence opt4 from hemagglutinin__InfluenzaA__AEW25573

SEQ ID NO: 160442 - RNA, 1701 nt, Artificial Sequence
  derived and/or modified sequence opt4 from hemagglutinin__InfluenzaA__AEW25582
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucauccugagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacggccagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160443 - RNA, 1701 nt, Artificial Sequence
  derived and/or modified sequence opt4 from hemagglutinin__InfluenzaA__AEW25590
augaaggccauccugguggugcugcuguacaccuucgccaccgccaacgccgacacccugugcaucggcuaccacgccaacaacagcaccgacaccguggacaccgugcuggagaagaacgugaccgugacccagagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggaggccagaaugaacuacuacuggacccugguggagcccggcgacaagaucaccuucgaggccaccggcaaccugguggugcccagauacgccuucgccauggagagagacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccugcacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160444 - RNA, 1701 nt, Artificial Sequence; identical to SEQ ID NO: 155987
  derived and/or modified sequence opt4 from hemagglutinin__InfluenzaA__AEW25600

SEQ ID NO: 160445 - RNA, 1701 nt, Artificial Sequence; identical to SEQ ID NO: 155987
  derived and/or modified sequence opt4 from hemagglutinin__InfluenzaA__AEW25620

SEQ ID NO: 160446 - RNA, 1701 nt, Artificial Sequence
  derived and/or modified sequence opt4 from hemagglutinin__InfluenzaA__AEW25629
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgaccccaacaagggcgugaccgccgccugcccccacgccgaggccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaugugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160447 - RNA, 1701 nt, Artificial Sequence; identical to SEQ ID NO: 155189
  derived and/or modified sequence opt4 from hemagglutinin__InfluenzaA__AEW25637

SEQ ID NO: 160448 - RNA, 1701 nt, Artificial Sequence
  derived and/or modified sequence opt4 from hemagglutinin__InfluenzaA__AEW25646
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgaccccaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160449 - RNA, 1701 nt, Artificial Sequence
  derived and/or modified sequence opt4 from hemagglutinin__InfluenzaA__AEW25654
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagcccccccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160450 - RNA, 1701 nt, Artificial Sequence
  derived and/or modified sequence opt4 from hemagglutinin__InfluenzaA__AEW25662
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgaccccaacaagggcaucaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160451 - RNA, 1701 nt, Artificial Sequence
  derived and/or modified sequence opt4 from hemagglutinin__InfluenzaA__AEW25669
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgaccccaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggagggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160452 - RNA, 1701 nt, Artificial Sequence
  derived and/or modified sequence opt4 from hemagglutinin__InfluenzaA__AEW25678
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagaaguucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugagagccaucagcuucuggaugugcagcaacggcagccugcagugcagaaucugcaucuga

SEQ ID NO: 160453 - RNA, 1701 nt, Artificial Sequence
  derived and/or modified sequence opt4 from hemagglutinin__InfluenzaA__AEW25687
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgaccccaacaagggcgugaccgccgccugccccuacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160454 - RNA, 1701 nt, Artificial Sequence; identical to SEQ ID NO: 160423
  derived and/or modified sequence opt4 from hemagglutinin__InfluenzaA__AEW25696

SEQ ID NO: 160455 - RNA, 1701 nt, Artificial Sequence; identical to SEQ ID NO: 155987
  derived and/or modified sequence opt4 from hemagglutinin__InfluenzaA__AEW25706

SEQ ID NO: 160456 - RNA, 1695 nt, Artificial Sequence
  derived and/or modified sequence opt4 from hemagglutinin__InfluenzaA__AEW91908
auggagaagaucgugcugcuguucgccaccaucagccuggugaagagcgaccacaucugcaucggcuaccacgccaacaacagcaccgagcagguggacaccaucauggagaagaacgugaccgugacccacgcccaggacauccuggagaagacccacaacggcaagcugugcgaccugaacggcgugaagccccugauccugaaggacugcagcguggccggcuggcugcugggcaaccccaugugcgacgaguucaucaacgugcccgaguggagcuacaucguggagaaggccaaccccgccaacgaccugugcuaccccggcaacuucaacgacuacgaggagcugaagcaccugcugagcagaaucaaccacuucgagaagauccagaucauccccaagaacagcuggagcgaccacgaggccagccugggcgugagcgccgccugccccuaccagggcaagagcagcuucuucagaaacgugguguggcugaucaagaaggacaacgccuaccccaccaucaagaagggcuacaacaacaccaaccaggaggaccugcuggugcuguggggcauccaccaccccaacgacgaggccgagcagaccagacuguaccagaaccccaccaccuacaucagcaucggcaccagcacccugaaccagagacuggugcccaagaucgccaccagaagcaagaucaacggccagagcggcagaaucgacuucuucuggaccauccugaagcccaacgacgccauccacuucgagagcaacggcaacuucaucgcccccgaguacgccuacaagaucgugaagaagggcgacagcaccaucaugaagagcgagguggaguacggcaacugcaacaccagaugccagacccccaucggcgccaucaacagcagcaugcccuuccacaacauccacccccugaccaucggcgagugccccaaguacgugaagagcaacaagcuggugcuggccaccggccugagaaacagcccccagggcgagaccagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugagaaaccuguacgacaaggugagacugcagcugaaggacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaucuaccagauccugagcaucuacagcaccguggccagcagccuggugcuggccaucaugauggccggccugagccuguggaugugcagcaacggcagccugcagugcagaaucugcaucuga

SEQ ID NO: 160457 - RNA, 1701 nt, Artificial Sequence
  derived and/or modified sequence opt4 from hemagglutinin__InfluenzaA__AEX09175
augaaggccauccugguggugcugcuguacaccuucgccaccgccaacgccgacacccugugcaucggcuaccacgccaacaacagcaccgacaccguggacaccgugcuggagaagaacguggccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagacagagagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160458 - RNA, 1701 nt, Artificial Sequence; identical to SEQ ID NO: 155189
  derived and/or modified sequence opt4 from hemagglutinin__InfluenzaA__AEX25795

SEQ ID NO: 160459 - RNA, 1701 nt, Artificial Sequence
  derived and/or modified sequence opt4 from hemagglutinin__InfluenzaA__AEX25797
auggaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcaacagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccacaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160460 - RNA, 1701 nt, Artificial Sequence
  derived and/or modified sequence opt4 from hemagglutinin__InfluenzaA__AEX25798
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccacaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160461 - RNA, 1701 nt, Artificial Sequence; identical to SEQ ID NO: 155189
  derived and/or modified sequence opt4 from hemagglutinin__InfluenzaA__AEX25800

SEQ ID NO: 160462 - RNA, 1701 nt, Artificial Sequence; identical to SEQ ID NO: 155189
  derived and/or modified sequence opt4 from hemagglutinin__InfluenzaA__AEX25803

SEQ ID NO: 160463 - RNA, 1701 nt, Artificial Sequence; identical to SEQ ID NO: 155431
  derived and/or modified sequence opt4 from hemagglutinin__InfluenzaA__AEX25808

SEQ ID NO: 160464 - RNA, 1701 nt, Artificial Sequence; identical to SEQ ID NO: 158159
  derived and/or modified sequence opt4 from hemagglutinin__InfluenzaA__AEX25810

SEQ ID NO: 160465 - RNA, 1701 nt, Artificial Sequence
  derived and/or modified sequence opt4 from hemagglutinin__InfluenzaA__AEX25811
auggaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccuguucaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaaggccggcagcggcaucaucaucagcgacacccccgugcacgacugcaacaccaccugccagacccccaagggcgccaucaacaccagccugcccuuccacaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160466 - RNA, 1701 nt, Artificial Sequence; identical to SEQ ID NO: 158159
  derived and/or modified sequence opt4 from hemagglutinin__InfluenzaA__AEX25814

SEQ ID NO: 160467 - RNA, 1701 nt, Artificial Sequence
  derived and/or modified sequence opt4 from hemagglutinin__InfluenzaA__AEX25816
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccaacagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160468 - RNA, 1701 nt, Artificial Sequence
  derived and/or modified sequence opt4 from hemagglutinin__InfluenzaA__AEX25818
auggaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcaacagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccagagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccacaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160469 - RNA, 1701 nt, Artificial Sequence
  derived and/or modified sequence opt4 from hemagglutinin__InfluenzaA__AEX25824
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacguggagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160470 - RNA, 1698 nt, Artificial Sequence
  derived and/or modified sequence opt4 from hemagglutinin__InfluenzaA__AEX33420
augaaggugaagcugcuggugcugcugugcaucuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagagcggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugaagagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 160471 - RNA, 1701 nt, Artificial Sequence
  derived and/or modified sequence opt4 from hemagglutinin__InfluenzaA__AEX33453
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcgacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160472 - RNA, 1701 nt, Artificial Sequence; identical to SEQ ID NO: 154315
  derived and/or modified sequence opt4 from hemagglutinin__InfluenzaA__AEX33464

SEQ ID NO: 160473 - RNA, 1701 nt, Artificial Sequence; identical to SEQ ID NO: 154315
  derived and/or modified sequence opt4 from hemagglutinin__InfluenzaA__AEX33475

SEQ ID NO: 160474 - RNA, 1701 nt, Artificial Sequence; identical to SEQ ID NO: 154315
  derived and/or modified sequence opt4 from hemagglutinin__InfluenzaA__AEX33486

SEQ ID NO: 160475 - RNA, 1701 nt, Artificial Sequence; identical to SEQ ID NO: 154315
  derived and/or modified sequence opt4 from hemagglutinin__InfluenzaA__AEX33497

SEQ ID NO: 160476 - RNA, 1701 nt, Artificial Sequence; identical to SEQ ID NO: 154315
  derived and/or modified sequence opt4 from hemagglutinin__InfluenzaA__AEX33508

SEQ ID NO: 160477 - RNA, 1701 nt, Artificial Sequence; identical to SEQ ID NO: 154315
  derived and/or modified sequence opt4 from hemagglutinin__InfluenzaA__AEX33519

SEQ ID NO: 160478 - RNA, 1701 nt, Artificial Sequence
  derived and/or modified sequence opt4 from hemagglutinin__InfluenzaA__AEX33541
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaucagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcagcugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160479 - RNA, 1701 nt, Artificial Sequence
  derived and/or modified sequence opt4 from hemagglutinin__InfluenzaA__AEX33574
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaagagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacgugcccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgacugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160480 - RNA, 1701 nt, Artificial Sequence; identical to SEQ ID NO: 154315
  derived and/or modified sequence opt4 from hemagglutinin__InfluenzaA__AEX33585

SEQ ID NO: 160481 - RNA, 1701 nt, Artificial Sequence
  derived and/or modified sequence opt4 from hemagglutinin__InfluenzaA__AEX33596
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaagagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160482 - RNA, 1701 nt, Artificial Sequence; identical to SEQ ID NO: 154315
  derived and/or modified sequence opt4 from hemagglutinin__InfluenzaA__AEX33618

SEQ ID NO: 160483 - RNA, 1701 nt, Artificial Sequence; identical to SEQ ID NO: 154315
  derived and/or modified sequence opt4 from hemagglutinin__InfluenzaA__AEX33629

SEQ ID NO: 160484 - RNA, 1701 nt, Artificial Sequence; identical to SEQ ID NO: 160481
  derived and/or modified sequence opt4 from hemagglutinin__InfluenzaA__AEX33640

SEQ ID NO: 160485 - RNA, 1701 nt, Artificial Sequence
  derived and/or modified sequence opt4 from hemagglutinin__InfluenzaA__AEX33836
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacaucuuccugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160486 - RNA, 1701 nt, Artificial Sequence; identical to SEQ ID NO: 153150
  derived and/or modified sequence opt4 from hemagglutinin__InfluenzaA__AEX33880

SEQ ID NO: 160487 - RNA, 1698 nt, Artificial Sequence
  derived and/or modified sequence opt4 from hemagglutinin__InfluenzaA__AEX33913
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcagagagagcuggagcuacaucguggagaagcccaaccccgagaacggcaccugcuaccccggccacuucgccgacuacgaggagcugagagagcagcugagcagcgugagcagcuucgagagauucgagaucuuccccaaggagaacagcuggcccaaccacaccaccaccggcgugagcgccagcugcagccacaacggcgagagcagcuucuacaagaaccugcuguggcugaccggcaagaacggccuguaccccaaccugagcaagagcuacgccaacaacaagaagaaggaggugcuggugcuguggggcgugcaccacccccccaacaucggcaaccagagagcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaaguucgagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 160488 - RNA, 1698 nt, Artificial Sequence
  derived and/or modified sequence opt4 from hemagglutinin__InfluenzaA__AEX33924
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagagccugaucagcagagagagcuggagcuacaucguggagaagcccagccccgagaacggcaccugcuaccccggccacuucgccgacuacgaggagcugagagagcagcugagcagcgugagcagcuucgagagauucgagaucuuccccaaggagagcagcuggcccaaccacaccgccaccggcgugagcgccagcugcagccacaacggcaagagcagcuucuacaagaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaaaguucacccccgagaucgccaagagacccaaggugagagaccagaagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 160489 - RNA, 1701 nt, Artificial Sequence
  derived and/or modified sequence opt4 from hemagglutinin__InfluenzaA__AEX33957
augaagaccaucaucgcccugagcuacauccugugccugguguucgcccagaagcugcccggcaucgacaacagcaccgccacccugugccugggccaccacgccgugcccaacggcaccaucgugaagaccaucaccaacgaccagguggaggugaccaacgccaccgagcuggugcagaacagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaggcagcaacaacagcuucuucagcagacugaacuggcugacccacagcaaguucaaguaccccgcccugaacgugaccaugcccaacaacgaggaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160490 - RNA, 1701 nt, Artificial Sequence
  derived and/or modified sequence opt4 from hemagglutinin__InfluenzaA__AEX33968
augaagaccaucaucgcccugagcuacauccugugccugguguucgcccagaagcugcccggcaucgacaacagcaccgccacccugugccugggccaccacgccgugcccaacggcaccaucgugaagaccaucaccaacgaccagaucgaggugaccaacgccaccgagcuggugcagaacagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaggcagcaacaacagcuucuucagcagacugaacuggcugacccacagcaaguucaaguaccccgcccugaacgugaccaugcccaacaacgaggaguucgacaagcuguacaucuggggcgugcaccaccccggcaccgacaacgaccagaucuuccugcacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160491 - RNA, 1701 nt, Artificial Sequence
  derived and/or modified sequence opt4 from hemagglutinin__InfluenzaA__AEX33979
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaacggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160492 - RNA, 1701 nt, Artificial Sequence
  derived and/or modified sequence opt4 from hemagglutinin__InfluenzaA__AEX33990
augaagaccaucaucgcccugagcuacauccuguaccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagauccagagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcaggacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagagcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160493 - RNA, 1701 nt, Artificial Sequence
  derived and/or modified sequence opt4 from hemagglutinin__InfluenzaA__AEX34001
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacagcgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacgccgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160494 - RNA, 1701 nt, Artificial Sequence
  derived and/or modified sequence opt4 from hemagglutinin__InfluenzaA__AEX34012
augaagaccaucaucgcccugagcuacauccuguaccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagauccagagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160495 - RNA, 1701 nt, Artificial Sequence; identical to SEQ ID NO: 154954
  derived and/or modified sequence opt4 from hemagglutinin__InfluenzaA__AEX34023

SEQ ID NO: 160496 - RNA, 1701 nt, Artificial Sequence
  derived and/or modified sequence opt4 from hemagglutinin__InfluenzaA__AEX34044
augaagaccaucaucgccuucagcuacauccugugccugguguucgcccagaagcugcccggcaucgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaggcagcaacaacagcuucuucagcagacugaacuggcugacccacagcaaguucaaguaccccgcccugaacgugaccaugcccaacaacgaggaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160497 - RNA, 1701 nt, Artificial Sequence
  derived and/or modified sequence opt4 from hemagglutinin__InfluenzaA__AEX34089
augaagaccaucaucgcccugagcuacauccugugccugguguucgcccagaagcugcccggcaucgacaacagcaccgccacccugugccugggccaccacgccgugcccaacggcaccaucgugaagaccaucaccaacgaccagaucgaggugaccaacgccaccgagcuggugcagaacagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaggcagcagcaacagcuucuucagcagacugaacuggcugacccacagcaaguucaaguaccccgcccugaacgugaccaugcccaacaacgaggaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160498 - RNA, 1701 nt, Artificial Sequence
  derived and/or modified sequence opt4 from hemagglutinin__InfluenzaA__AEX34123
augaagaccaucaucgcccugagcuacauccugugccugguguucgcccagaagcugcccggcaucgacaacagcaccgccacccugugccugggccaccacgccgugcccaacggcaccaucgugaagaccaucaccaacgaccagaucgaggugaccaacgccaccgagcuggugcagaacagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaggcagcaacaacagcuucuucagcagacugaacuggcugacccacagcaaguucaaguaccccgcccugaacgugaccaugcccaacaacgaggaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160499 - RNA, 1701 nt, Artificial Sequence
  derived and/or modified sequence opt4 from hemagglutinin__InfluenzaA__AEX34134
augaagaccaucaucgcccugagcuacauccugugccugguguucgcccagaagcugcccggcaacgacaacagcauggccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160500 - RNA, 1701 nt, Artificial Sequence; identical to SEQ ID NO: 160498
  derived and/or modified sequence opt4 from hemagglutinin__InfluenzaA__AEX34145

SEQ ID NO: 160501 - RNA, 1701 nt, Artificial Sequence
  derived and/or modified sequence opt4 from hemagglutinin__InfluenzaA__AEX34156
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcggcagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 160502 - RNA, 1701 nt, Artificial Sequence; identical to SEQ ID NO: 154448
  derived and/or modified sequence opt4 from hemagglutinin__InfluenzaA__AEX34178

SEQ ID NO: 160503 - RNA, 1701 nt, Artificial Sequence
  derived and/or modified sequence opt4 from hemagglutinin__InfluenzaA__AEX34188
augaagaccaucaucgcccugagcuacauccugugccugguguucgcccagaaguuccccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaacugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagaacuucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgcccugcugggcuucaucaugugggccugccagaagggcaacaucagaugcaacaucugcaucuga

SEQ ID NO: 160504 - RNA, 1701 nt, Artificial Sequence; identical to SEQ ID NO: 154954
  derived and/or modified sequence opt4 from hemagglutinin__InfluenzaA__AEX34199

SEQ ID NO: 160505 - RNA, 1701 nt, Artificial Sequence
  derived and/or modified sequence opt4 from hemagglutinin__InfluenzaA__AEX34221
augaagaccaucaucgcccugagcuacauccugugccugguguucgcccagaagcugcccggcaucgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaggcagcaacaacagcuucuucagcagacugaacuggcugacccacagcaaguucaaguaccccgcccugaacgugaccaugcccaacaacgaggaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcgacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160506 - RNA, 1701 nt, Artificial Sequence; identical to SEQ ID NO: 154448
  derived and/or modified sequence opt4 from hemagglutinin__InfluenzaA__AEX34243

SEQ ID NO: 160507 - RNA, 1701 nt, Artificial Sequence; identical to SEQ ID NO: 160503
  derived and/or modified sequence opt4 from hemagglutinin__InfluenzaA__AEX34254

SEQ ID NO: 160508 - RNA, 1701 nt, Artificial Sequence; identical to SEQ ID NO: 154448
  derived and/or modified sequence opt4 from hemagglutinin__InfluenzaA__AEX34265

SEQ ID NO: 160509 - RNA, 1701 nt, Artificial Sequence
  derived and/or modified sequence opt4 from hemagglutinin__InfluenzaA__AEX34275
augaagaccaucaucgcccugagcuacauccugugccugguguucgcccagaagcugcccggcaucgacaacagcaccgccacccugugccugggccaccacgccgugcccaacggcaccaucgugaagaccaucaccaacgaccagaucgaggugaccaacgccaccgagcuggugcagaacagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaggcagcaacaacagcuucuucagcagacugaacuggcugacccacagcaaguucaaguaccccgcccugaacgugaccaugcccaacaacgaggaguucgacaagcuguacaucuggggcgugcugcaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacuacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160510 - RNA, 1698 nt, Artificial Sequence; identical to SEQ ID NO: 155008
  derived and/or modified sequence opt4 from hemagglutinin__InfluenzaA__AEX34318

SEQ ID NO: 160511 - RNA, 1698 nt, Artificial Sequence
  derived and/or modified sequence opt4 from hemagglutinin__InfluenzaA__AEX34329
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcuggugagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgagggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 160512 - RNA, 1701 nt, Artificial Sequence
  derived and/or modified sequence opt4 from hemagglutinin__InfluenzaA__AEX34352
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccugaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160513 - RNA, 1701 nt, Artificial Sequence; identical to SEQ ID NO: 154954
  derived and/or modified sequence opt4 from hemagglutinin__InfluenzaA__AEX34364

SEQ ID NO: 160514 - RNA, 1701 nt, Artificial Sequence; identical to SEQ ID NO: 154954
  derived and/or modified sequence opt4 from hemagglutinin__InfluenzaA__AEX34375

SEQ ID NO: 160515 - RNA, 1701 nt, Artificial Sequence
  derived and/or modified sequence opt4 from hemagglutinin__InfluenzaA__AEX34386
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucaucgagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160516 - RNA, 1701 nt, Artificial Sequence
  derived and/or modified sequence opt4 from hemagglutinin__InfluenzaA__AEX34407
augaagaccaucaucgcccugagcuacauccugugccugguguucgcccagaagcugcccggcaacgacaacagcauggccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagauccugagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagguggaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160517 - RNA, 1698 nt, Artificial Sequence
  derived and/or modified sequence opt4 from hemagglutinin__InfluenzaA__AEX34440
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaccagcagagagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccaccaccggcgugagcgccagcugcagccacaacggcgagagcagcuucuacaagaaccugcuguggcugaccggcaagaacggccuguaccccaaccugagcaagagcuacgccaacaacaaggagaaggaggugcuggugcuguggggcgugcaccacccccccaacaucggcaaccagagagcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 160518 - RNA, 1698 nt, Artificial Sequence; identical to SEQ ID NO: 152819
  derived and/or modified sequence opt4 from hemagglutinin__InfluenzaA__AEX34462

SEQ ID NO: 160519 - RNA, 1698 nt, Artificial Sequence
  derived and/or modified sequence opt4 from hemagglutinin__InfluenzaA__AEX34473
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagagcggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugaagagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagagcgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 160520 - RNA, 1698 nt, Artificial Sequence
  derived and/or modified sequence opt4 from hemagglutinin__InfluenzaA__AEX34495
augaaggugaagcugcuggugcugcugugcaucuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagagcggccuguaccccaaccugagcaagagcuacgccaacaacaaggagaaggaggugcuggugcuguggggcgugcaccacccccccaacaucggcgugcagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugaagagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 160521 - RNA, 1698 nt, Artificial Sequence; identical to SEQ ID NO: 160520
  derived and/or modified sequence opt4 from hemagglutinin__InfluenzaA__AEX34506

SEQ ID NO: 160522 - RNA, 1698 nt, Artificial Sequence; identical to SEQ ID NO: 160520
  derived and/or modified sequence opt4 from hemagglutinin__InfluenzaA__AEX34517

SEQ ID NO: 160523 - RNA, 1698 nt, Artificial Sequence; identical to SEQ ID NO: 160520
  derived and/or modified sequence opt4 from hemagglutinin__InfluenzaA__AEX34528

SEQ ID NO: 160524 - RNA, 1698 nt, Artificial Sequence; identical to SEQ ID NO: 160520
  derived and/or modified sequence opt4 from hemagglutinin__InfluenzaA__AEX34539

SEQ ID NO: 160525 - RNA, 1698 nt, Artificial Sequence; identical to SEQ ID NO: 160520
  derived and/or modified sequence opt4 from hemagglutinin__InfluenzaA__AEX34550

SEQ ID NO: 160526 - RNA, 1698 nt, Artificial Sequence; identical to SEQ ID NO: 160520
  derived and/or modified sequence opt4 from hemagglutinin__InfluenzaA__AEX34561

SEQ ID NO: 160527 - RNA, 1698 nt, Artificial Sequence; identical to SEQ ID NO: 160520
  derived and/or modified sequence opt4 from hemagglutinin__InfluenzaA__AEX34572

SEQ ID NO: 160528 - RNA, 1698 nt, Artificial Sequence; identical to SEQ ID NO: 160520
  derived and/or modified sequence opt4 from hemagglutinin__InfluenzaA__AEX34583

SEQ ID NO: 160529 - RNA, 1698 nt, Artificial Sequence; identical to SEQ ID NO: 160520
  derived and/or modified sequence opt4 from hemagglutinin__InfluenzaA__AEX34594

SEQ ID NO: 160530 - RNA, 1698 nt, Artificial Sequence; identical to SEQ ID NO: 160520
  derived and/or modified sequence opt4 from hemagglutinin__InfluenzaA__AEX34605

SEQ ID NO: 160531 - RNA, 1698 nt, Artificial Sequence; identical to SEQ ID NO: 160520
  derived and/or modified sequence opt4 from hemagglutinin__InfluenzaA__AEX34616

SEQ ID NO: 160532 - RNA, 1698 nt, Artificial Sequence; identical to SEQ ID NO: 160520
  derived and/or modified sequence opt4 from hemagglutinin__InfluenzaA__AEX34627

SEQ ID NO: 160533 - RNA, 1698 nt, Artificial Sequence; identical to SEQ ID NO: 160520
  derived and/or modified sequence opt4 from hemagglutinin__InfluenzaA__AEX34638

SEQ ID NO: 160534 - RNA, 1698 nt, Artificial Sequence
  derived and/or modified sequence opt4 from hemagglutinin__InfluenzaA__AEX34650
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcaaccagagaagccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 160535 - RNA, 1698 nt, Artificial Sequence
  derived and/or modified sequence opt4 from hemagglutinin__InfluenzaA__AEX34661
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaagggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaagaaggugaacagcgugaucgagaagaugaacacccaguucaccgccgugggcaaggaguucagcaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 160536 - RNA, 1698 nt, Artificial Sequence
  derived and/or modified sequence opt4 from hemagglutinin__InfluenzaA__AEX34672
augaaggugaagcugcuggugcugcugugcaccuucaccgccaccuacgccgacaccaucugcaucggcuaccacgccaacaacagcaccgacaccguggacaccgugcuggacaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcagagagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccaccaccggcgugagcgccagcugcagccacgacggcgagagcagcuucuacaagaaccugcuguggcugaccggcaagaacggccuguaccccaaccugagcaagagcuacgccaacaacaaggagaaggaggugcuggugcuguggggcgugcaccacccccccaacaucggcgugcagagagcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 160537 - RNA, 1698 nt, Artificial Sequence
  derived and/or modified sequence opt4 from hemagglutinin__InfluenzaA__AEX34683
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcagagagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccuaccacaccaccaccggcgugagcgccagcugcagccacaacggcgagagcagcuucuacaagaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcuucggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 160538 - RNA, 1698 nt, Artificial Sequence
  derived and/or modified sequence opt4 from hemagglutinin__InfluenzaA__AEX34757
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcagagagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccaccaccggcgugagcgccagcugcagccacaacggcggcagcagcuucuacaagaaccugcuguggcugaccagaaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 160539 - RNA, 1698 nt, Artificial Sequence
  derived and/or modified sequence opt4 from hemagglutinin__InfluenzaA__AEX34768
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcagagagagcuggagcuacaucguggagaagcccaaccccgagaacggcaccugcuaccccggccacuucgccgacuacgaggagcugagagagcagcugagcagcgugagcagcuucgagagauucgagaucuuccccaaggacagcagcuggcccaaccacaccaccaccggcgugagcgccagcugcagccacaacggcgagagcagcuucuacaagaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaaaguucacccccgagaucgccaagagacccaaggugagagaccagggcggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 160540 - RNA, 1698 nt, Artificial Sequence
  derived and/or modified sequence opt4 from hemagglutinin__InfluenzaA__AEX34779
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagaagcuucuacagaaaccugcuguggcugaccggcaagaacggccuguaccccaaccugagcaagagcuacgccaacaacaaggagaaggaggugcuggugcuguggggcgugcaccacccccccaacaucggcaaccagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 160541 - RNA, 1698 nt, Artificial Sequence; identical to SEQ ID NO: 156617
  derived and/or modified sequence opt4 from hemagglutinin__InfluenzaA__AEX34790

SEQ ID NO: 160542 - RNA, 1698 nt, Artificial Sequence
  derived and/or modified sequence opt4 from hemagglutinin__InfluenzaA__AEX34801
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacaaccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcgccugcuaccccggccacuucgccgacuacgaggagcugagagagcagcugagcagcgugagcagcuucaagagauucgagaucuuccccaaggagagcagcuggcccaaccacaccgugaccggcgugagcgccagcugcagccacaacggcgagagcagcuucuacaagaaccugcuguggcugaccggcaagaacggccuguaccccaaccugagcaagagcuacgccaacaacaaggagaaggaggugcuggugcuguggggcgugcaccacccccccaacaucggcgaccagaugacccuguaccacaaggagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccagcggcaaccugaucgcccccagauacgccuucgcccugagcagaggcuucggcagcggcaucaucaacagcgacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacguguggaccuacaacgccgagcugcuggugcugcuggagaacgagagaacccuggacuuccacgacagcaacgugaagaaccuguacgagaaggugaagaaccagcugaagaacaacgccaaggagaucggcaacggcugcuucgaguucuaccacaagugcaacgacgagugcauggagagcgugaagaacggcaccuacgacuaccccaaguacagcgaggagagcaagcugagcagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 160543 - RNA, 1698 nt, Artificial Sequence
  derived and/or modified sequence opt4 from hemagglutinin__InfluenzaA__AEX34812
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucgacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 160544 - RNA, 1698 nt, Artificial Sequence
  derived and/or modified sequence opt4 from hemagglutinin__InfluenzaA__AEX34834
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacaaccacaacggcaagcugugccugcugaagggcaucgccccccugcagcugggcaacugcagcguggccggcuggauccugggcaaccccgagugcgagcugcugaacagcaaggagagcuggagcuacaucguggagaagcccaaccccgagaacggcaccugcuaccccggccacuucgccgacuacgaggagcugagagagcagcugagcagcgugagcagcuucaagagauucgagaucuuccccaaggagagcagcuggcccaaccacaccgugaccggcgugagcgccagcugcagccacaacggcgagagcagcuucuacaagaaccugcuguggcugaccggcaagaacggccuguaccccaaccugagcaagagcuacgccaacaacaaggagaaggaggugcuggugcuguggggcgugcaccacccccccaacaucggcgaccagaugacccuguaccacaaggagaacgccuacgugagcguggugagcagccacuacagcagaaaguucacccccgagaucaccaagagacccaaggugagagaccaggagggcagaaucaacuacuacuggacccugcuggagcccggcgacaccaucaucuucgaggccagcggcaaccugaucgcccccagauacgccuucgcccugagcagaggcuucggcagcggcaucaucaacagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacguguggaccuacaacgccgagcugcuggugcugcuggagaacgagagaacccuggacuuccacgacagcaacgugaagaaccuguacgagaaggugaagaaccagcugaagaacaacgccaaggagaucggcaacggcugcuucgaguucuaccacaagugcaacgacgagugcauggagagcgugaagaacggcaccuacgacuaccccaaguacagcgaggagagcaagcugagcagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 160545 - RNA, 1698 nt, Artificial Sequence
  derived and/or modified sequence opt4 from hemagglutinin__InfluenzaA__AEX34845
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcuggugcccaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgagggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 160546 - RNA, 1698 nt, Artificial Sequence; identical to SEQ ID NO: 156617
  derived and/or modified sequence opt4 from hemagglutinin__InfluenzaA__AEX34856

SEQ ID NO: 160547 - RNA, 1698 nt, Artificial Sequence
  derived and/or modified sequence opt4 from hemagglutinin__InfluenzaA__AEX34867
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcuggugagcaaggagagcuggagcuacaucguggagaagcccaaccccgagaacggcaccugcuaccccggccacuucgccgacuacgaggagcugagagagcagcugaucagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagacccccagaggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgagggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 160548 - RNA, 1698 nt, Artificial Sequence; identical to SEQ ID NO: 156617
  derived and/or modified sequence opt4 from hemagglutinin__InfluenzaA__AEX34878

SEQ ID NO: 160549 - RNA, 1698 nt, Artificial Sequence
  derived and/or modified sequence opt4 from hemagglutinin__InfluenzaA__AEX34889
augaaggugaaccugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 160550 - RNA, 1698 nt, Artificial Sequence
  derived and/or modified sequence opt4 from hemagglutinin__InfluenzaA__AEX34900
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacaaccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacaagaaccugcuguggcugaccggcaagaacggccuguaccccaaccugagcaagagcuacgccaacaacaaggagaaggaggugcuggugcuguggggcgugcaccacccccccaacaucggcgaccagaugacccuguaccacaaggagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccagcggcaaccugaucgcccccagauacgccuucgcccugagcagaggcuucggcagcggcaucaucaacagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcgugaccaacaaggugaacagcgugaucgagaagaugaacacccaguucaccgccgugggcaaggaguucaacaagcuggagagaagaauggagaaccugaacaagaagguggacgacggcuucaucgacguguggaccuacaacgccgagcugcuggugcugcuggagaacgagagaacccuggacuuccacgacagcaacgugaagaaccuguacgagaaggugaagaaccagcugaagaacaacgccaaggagaucggcaacggcugcuucgaguucuaccacaagugcaacgacgagugcauggagagcgugaagaacggcaccuacgacuaccccaaguacagcgaggagagcaagcugagcagagagaagaucgacggcguggagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 160551 - RNA, 1698 nt, Artificial Sequence
  derived and/or modified sequence opt4 from hemagglutinin__InfluenzaA__AEX34911
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagccaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcugggcagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 160552 - RNA, 1698 nt, Artificial Sequence
  derived and/or modified sequence opt4 from hemagglutinin__InfluenzaA__AEX34922
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccuggacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 160553 - RNA, 1698 nt, Artificial Sequence; identical to SEQ ID NO: 155008
  derived and/or modified sequence opt4 from hemagglutinin__InfluenzaA__AEX34933

SEQ ID NO: 160554 - RNA, 1698 nt, Artificial Sequence; identical to SEQ ID NO: 155008
  derived and/or modified sequence opt4 from hemagglutinin__InfluenzaA__AEX34944

SEQ ID NO: 160555 - RNA, 1698 nt, Artificial Sequence
  derived and/or modified sequence opt4 from hemagglutinin__InfluenzaA__AEX34955
augaaggccaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 160556 - RNA, 1698 nt, Artificial Sequence
  derived and/or modified sequence opt4 from hemagglutinin__InfluenzaA__AEX34966
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucauguucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 160557 - RNA, 1698 nt, Artificial Sequence; identical to SEQ ID NO: 160556
  derived and/or modified sequence opt4 from hemagglutinin__InfluenzaA__AEX34977

SEQ ID NO: 160558 - RNA, 1698 nt, Artificial Sequence; identical to SEQ ID NO: 160556
  derived and/or modified sequence opt4 from hemagglutinin__InfluenzaA__AEX34988

SEQ ID NO: 160559 - RNA, 1698 nt, Artificial Sequence; identical to SEQ ID NO: 156617
  derived and/or modified sequence opt4 from hemagglutinin__InfluenzaA__AEX34999

SEQ ID NO: 160560 - RNA, 1698 nt, Artificial Sequence; identical to SEQ ID NO: 160556
  derived and/or modified sequence opt4 from hemagglutinin__InfluenzaA__AEX35010

SEQ ID NO: 160561 - RNA, 1698 nt, Artificial Sequence; identical to SEQ ID NO: 160556
  derived and/or modified sequence opt4 from hemagglutinin__InfluenzaA__AEX35032

SEQ ID NO: 160562 - RNA, 1698 nt, Artificial Sequence; identical to SEQ ID NO: 160556
  derived and/or modified sequence opt4 from hemagglutinin__InfluenzaA__AEX35043

SEQ ID NO: 160563 - RNA, 1698 nt, Artificial Sequence
  derived and/or modified sequence opt4 from hemagglutinin__InfluenzaA__AEX35054
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucauguucgaggccaacggcaaccugaucgcccccagauacgccuucgcccugaacagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 160564 - RNA, 1698 nt, Artificial Sequence; identical to SEQ ID NO: 160556
  derived and/or modified sequence opt4 from hemagglutinin__InfluenzaA__AEX35065

SEQ ID NO: 160565 - RNA, 1698 nt, Artificial Sequence; identical to SEQ ID NO: 155008
  derived and/or modified sequence opt4 from hemagglutinin__InfluenzaA__AEX35076

SEQ ID NO: 160566 - RNA, 1698 nt, Artificial Sequence
  derived and/or modified sequence opt4 from hemagglutinin__InfluenzaA__AEX35087
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacaaccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucaagagauucgagaucuuccccaaggagagcagcuggcccaaccacaccgugaccggcgugagcgccagcugcagccacaacggcgagagcagcuucuacaagaaccugcuguggcugaccggcaagaacggccuguaccccaaccugagcaagagcuacgccaacaacaaggagaaggaggugcuggugcuguggggcgugcaccacccccccaacaucggcgaccagaugacccuguaccacaaggagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccagcggcaaccugaucgcccccagauacgccuucgcccugagcagaggcuucggcagcggcaucaucaacagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacguguggaccuacaacgccgagcugcuggugcugcuggagaacgagagaacccuggacuuccacgacagcaacgugaagaaccuguacgagaaggugaagaaccagcugaagaacaacgccaaggagaucggcaacggcugcuucgaguucuaccacaagugcaacgacgagugcauggagagcgugaagaacggcaccuacgacuaccccaaguacagcgaggagagcaagcugagcagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 160567 - RNA, 1698 nt, Artificial Sequence
  derived and/or modified sequence opt4 from hemagglutinin__InfluenzaA__AEX35098
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcgugaugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 160568 - RNA, 1698 nt, Artificial Sequence
  derived and/or modified sequence opt4 from hemagglutinin__InfluenzaA__AEX35109
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccagccccccaacaucggcgaccagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 160569 - RNA, 1698 nt, Artificial Sequence
  derived and/or modified sequence opt4 from hemagglutinin__InfluenzaA__AEX35120
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaaaguucacccccgagaucgccaagagacccaaggugagagacagagagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 160570 - RNA, 1698 nt, Artificial Sequence; identical to SEQ ID NO: 160313
  derived and/or modified sequence opt4 from hemagglutinin__InfluenzaA__AEX35131

SEQ ID NO: 160571 - RNA, 1698 nt, Artificial Sequence; identical to SEQ ID NO: 160313
  derived and/or modified sequence opt4 from hemagglutinin__InfluenzaA__AEX35142

SEQ ID NO: 160572 - RNA, 1698 nt, Artificial Sequence
  derived and/or modified sequence opt4 from hemagglutinin__InfluenzaA__AEX35153
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacaaccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacaagaaccugcuguggcugaccggcaagaacggccuguaccccaaccugagcaagagcuacgccaacaacaaggagaaggaggugcuggugcuguggggcgugcaccacccccccaacaucggcaaccagaugacccuguaccacaaggagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccagcggcaaccugaucgcccccagauacgccuucgcccugagcagaggcuucggcagcggcaucaucaacagcaacgcccccauggacgagugcgacgccaagugccagaccccccagggcgccaucaacagcaaccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacguguggaccuacaacgccgagcugcuggugcugcuggagaacgagagaacccuggacuuccacgacagcaacgugaagagccuguacgagaaggugaagaaccagcugaagaacaacgccaaggagaucggcaacggcugcuucgaguucuaccacaagugcaacgacgagugcauggagagcgugaagaacggcaccuacgacuaccccaaguacagcgaggagagcaagcugagcagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 160573 - RNA, 1698 nt, Artificial Sequence
  derived and/or modified sequence opt4 from hemagglutinin__InfluenzaA__AEX35164
augaaggugaagcugcuggugcugcugugcgccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgugcagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 160574 - RNA, 1698 nt, Artificial Sequence
  derived and/or modified sequence opt4 from hemagglutinin__InfluenzaA__AEX35175
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcguggaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugaccgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugaacagaggcuucggcagcggcaucaucaccagcaacgcccccauggacggcugcgacgccaagugccagaccccccagggcgccaucaacagcagccugcccuuccagaacgugcaccccgugaccaucggcgagugccccaaguacgugagaagcgccaagcugagaauggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucagcaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 160575 - RNA, 1698 nt, Artificial Sequence
  derived and/or modified sequence opt4 from hemagglutinin__InfluenzaA__AEX35186
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcagagagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccaccaccggcgugagcgccagcugcagccacaacggcgagagcagcuucuacaagaaccugcuguggcugaccggcaagaacggccuguaccccaaccugagcaagagcuacgccaacaacaaggagaaggaggugcuggugcuguggggcgugcaccacccccccaacaucggcaaccagagagcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 160576 - RNA, 1698 nt, Artificial Sequence; identical to SEQ ID NO: 160575
  derived and/or modified sequence opt4 from hemagglutinin__InfluenzaA__AEX35197

SEQ ID NO: 160577 - RNA, 1698 nt, Artificial Sequence; identical to SEQ ID NO: 155008
  derived and/or modified sequence opt4 from hemagglutinin__InfluenzaA__AEX35208

SEQ ID NO: 160578 - RNA, 1701 nt, Artificial Sequence
  derived and/or modified sequence opt4 from hemagglutinin__InfluenzaA__AEX35219
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaugagcugcuuccugcugugcguggugcugcugggcuucaucaugugggccugccagaagggcaacaucagaugcaacaucugcaucuga

SEQ ID NO: 160579 - RNA, 1698 nt, Artificial Sequence; identical to SEQ ID NO: 160520
  derived and/or modified sequence opt4 from hemagglutinin__InfluenzaA__AEX35230

SEQ ID NO: 160580 - RNA, 1701 nt, Artificial Sequence; identical to SEQ ID NO: 154417
  derived and/or modified sequence opt4 from hemagglutinin__InfluenzaA__AEX35241

SEQ ID NO: 160581 - RNA, 1698 nt, Artificial Sequence; identical to SEQ ID NO: 160520
  derived and/or modified sequence opt4 from hemagglutinin__InfluenzaA__AEX35263

SEQ ID NO: 160582 - RNA, 1698 nt, Artificial Sequence; identical to SEQ ID NO: 160520
  derived and/or modified sequence opt4 from hemagglutinin__InfluenzaA__AEX35274

SEQ ID NO: 160583 - RNA, 1701 nt, Artificial Sequence; identical to SEQ ID NO: 154315
  derived and/or modified sequence opt4 from hemagglutinin__InfluenzaA__AEX35285

SEQ ID NO: 160584 - RNA, 1701 nt, Artificial Sequence; identical to SEQ ID NO: 160481
  derived and/or modified sequence opt4 from hemagglutinin__InfluenzaA__AEX35296

SEQ ID NO: 160585 - RNA, 1701 nt, Artificial Sequence
  derived and/or modified sequence opt4 from hemagglutinin__InfluenzaA__AEX35307
augaagaccaucaucgcccugagcuacauccugugccugguguucgcccagaagauccccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 160586 - RNA, 1701 nt, Artificial Sequence; identical to SEQ ID NO: 160481
  derived and/or modified sequence opt4 from hemagglutinin__InfluenzaA__AEX35318

SEQ ID NO: 160587 - RNA, 1701 nt, Artificial Sequence
  derived and/or modified sequence opt4 from hemagglutinin__InfluenzaA__AEX35329
augaagaccaucaucgcccugagcuacuuccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160588 - RNA, 1701 nt, Artificial Sequence
  derived and/or modified sequence opt4 from hemagglutinin__InfluenzaA__AEX35340
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160589 - RNA, 1701 nt, Artificial Sequence; identical to SEQ ID NO: 160481
  derived and/or modified sequence opt4 from hemagglutinin__InfluenzaA__AEX35351

SEQ ID NO: 160590 - RNA, 1701 nt, Artificial Sequence; identical to SEQ ID NO: 160481
  derived and/or modified sequence opt4 from hemagglutinin__InfluenzaA__AEX35362

SEQ ID NO: 160591 - RNA, 1701 nt, Artificial Sequence; identical to SEQ ID NO: 154315
  derived and/or modified sequence opt4 from hemagglutinin__InfluenzaA__AEX35373

SEQ ID NO: 160592 - RNA, 1701 nt, Artificial Sequence
  derived and/or modified sequence opt4 from hemagglutinin__InfluenzaA__AEX35384
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaagagcuucuucagcagacugaacuggcugacccaccugaaguucaaguaccccgcccugagcgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagaaccagagugagagacgugcccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160593 - RNA, 1701 nt, Artificial Sequence
  derived and/or modified sequence opt4 from hemagglutinin__InfluenzaA__AEX35395
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaaguggaaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaagagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacgugcccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160594 - RNA, 1701 nt, Artificial Sequence; identical to SEQ ID NO: 154315
  derived and/or modified sequence opt4 from hemagglutinin__InfluenzaA__AEX35406

SEQ ID NO: 160595 - RNA, 1701 nt, Artificial Sequence; identical to SEQ ID NO: 154315
  derived and/or modified sequence opt4 from hemagglutinin__InfluenzaA__AEX35417

SEQ ID NO: 160596 - RNA, 1701 nt, Artificial Sequence
  derived and/or modified sequence opt4 from hemagglutinin__InfluenzaA__AEX35428
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccacugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccuguucaucaacagcaccggcaaccugaucgcccccagaggcuacuucaagaucagaagcggcaagagcagcaucaugagaagcgacgcccccaucgacaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160597 - RNA, 1698 nt, Artificial Sequence
  derived and/or modified sequence opt4 from hemagglutinin__InfluenzaA__AEX35439
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 160598 - RNA, 1701 nt, Artificial Sequence
  derived and/or modified sequence opt4 from hemagglutinin__InfluenzaA__AEX35450
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagaacuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagauccagagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160599 - RNA, 1701 nt, Artificial Sequence; identical to SEQ ID NO: 153150
  derived and/or modified sequence opt4 from hemagglutinin__InfluenzaA__AEX35461

SEQ ID NO: 160600 - RNA, 1701 nt, Artificial Sequence
  derived and/or modified sequence opt4 from hemagglutinin__InfluenzaA__AEX35472
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacgacuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 160601 - RNA, 1701 nt, Artificial Sequence; identical to SEQ ID NO: 153150
  derived and/or modified sequence opt4 from hemagglutinin__InfluenzaA__AEX35483

SEQ ID NO: 160602 - RNA, 1701 nt, Artificial Sequence
  derived and/or modified sequence opt4 from hemagglutinin__InfluenzaA__AEX35494
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggccugcagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160603 - RNA, 1701 nt, Artificial Sequence
  derived and/or modified sequence opt4 from hemagglutinin__InfluenzaA__AEX35505
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacgacuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagauccugagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160604 - RNA, 1701 nt, Artificial Sequence
  derived and/or modified sequence opt4 from hemagglutinin__InfluenzaA__AEX35516
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggccugcagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160605 - RNA, 1701 nt, Artificial Sequence
  derived and/or modified sequence opt4 from hemagglutinin__InfluenzaA__AEX35527
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgugagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160606 - RNA, 1701 nt, Artificial Sequence
  derived and/or modified sequence opt4 from hemagglutinin__InfluenzaA__AEX35549
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugaucgccagcagcggcacccuggaguucaacaacgagagcuucaacuggaccggcgugacccagaacggcaccagcagcgccugcaagagaggcagcaacaacagcuucuucagcagacugaacuggcugacccaccugaaguucaaguaccccgcccugaacgugaccaugcccaacaacgaggaguucgacaagcuguacaucuggggcgugcaccaccccggcaccgacaacgaccagaucagccuguacgcccaggccagcggcaagaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucgacaagugcaacagcgagugcaucacccccaacggcagcauccccaacgacaagcccuuccagaacgugaacaagaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160607 - RNA, 1701 nt, Artificial Sequence
  derived and/or modified sequence opt4 from hemagglutinin__InfluenzaA__AEX35560
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgugagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgugggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160608 - RNA, 1701 nt, Artificial Sequence
  derived and/or modified sequence opt4 from hemagglutinin__InfluenzaA__AEX35571
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcagagccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160609 - RNA, 1701 nt, Artificial Sequence; identical to SEQ ID NO: 153150
  derived and/or modified sequence opt4 from hemagglutinin__InfluenzaA__AEX35582

SEQ ID NO: 160610 - RNA, 1701 nt, Artificial Sequence
  derived and/or modified sequence opt4 from hemagglutinin__InfluenzaA__AEX35593
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgccccccugggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160611 - RNA, 1701 nt, Artificial Sequence; identical to SEQ ID NO: 154892
  derived and/or modified sequence opt4 from hemagglutinin__InfluenzaA__AEX35604

SEQ ID NO: 160612 - RNA, 1701 nt, Artificial Sequence
  derived and/or modified sequence opt4 from hemagglutinin__InfluenzaA__AEX35615
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacaucgaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160613 - RNA, 1701 nt, Artificial Sequence; identical to SEQ ID NO: 154954
  derived and/or modified sequence opt4 from hemagglutinin__InfluenzaA__AEX35626

SEQ ID NO: 160614 - RNA, 1701 nt, Artificial Sequence
  derived and/or modified sequence opt4 from hemagglutinin__InfluenzaA__AEX35637
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaggcagcgacaacagcuucuucagcaagcugaacuggcugacccaccugaaguucaaguaccccgcccugaacgugaccaugcccaacaacgagaaguucgacaagcuguacaucuggggcgugcaccaccccggcaccgacaacgaccagaucuuccccuacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160615 - RNA, 1701 nt, Artificial Sequence; identical to SEQ ID NO: 154954
  derived and/or modified sequence opt4 from hemagglutinin__InfluenzaA__AEX35648

SEQ ID NO: 160616 - RNA, 1701 nt, Artificial Sequence
  derived and/or modified sequence opt4 from hemagglutinin__InfluenzaA__AEX36102
augaagaccaucaucgcccugagcuacauccugugccugguguucgcccagaagcugcccggcaacaacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160617 - RNA, 1701 nt, Artificial Sequence; identical to SEQ ID NO: 154435
  derived and/or modified sequence opt4 from hemagglutinin__InfluenzaA__AEX36113

SEQ ID NO: 160618 - RNA, 1701 nt, Artificial Sequence; identical to SEQ ID NO: 154954
  derived and/or modified sequence opt4 from hemagglutinin__InfluenzaA__AEX36124

SEQ ID NO: 160619 - RNA, 1701 nt, Artificial Sequence
  derived and/or modified sequence opt4 from hemagglutinin__InfluenzaA__AEX36146
augaagaccaucaucgcccugagcuacauccugugccuggugcuggcccagaagcugcccggcgacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160620 - RNA, 1701 nt, Artificial Sequence
  derived and/or modified sequence opt4 from hemagglutinin__InfluenzaA__AEX36168
augaagaccaucaucgcccugagcuacauccugugccugguguucgcccagaagcugcccggcaucgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaagagaggcagcgacaacagcuucuucagcagacugaacuggcugacccaccugaaguucaaguaccccgcccugaacgugaccaugcccaacaacgaggaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacaagcugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauucaagaucaagggcguggagcugaagagcggcuacaaggacuggauccuguggaucagcuucgccaucagcugcuuccugcugugcguggcccugcugggcuucaucaugugggccugccagaagggcaacaucaagugcaacaucugcaucuga

SEQ ID NO: 160621 - RNA, 1701 nt, Artificial Sequence; identical to SEQ ID NO: 154954
  derived and/or modified sequence opt4 from hemagglutinin__InfluenzaA__AEX36179

SEQ ID NO: 160622 - RNA, 1701 nt, Artificial Sequence; identical to SEQ ID NO: 160503
  derived and/or modified sequence opt4 from hemagglutinin__InfluenzaA__AEX36190

SEQ ID NO: 160623 - RNA, 1701 nt, Artificial Sequence; identical to SEQ ID NO: 160498
  derived and/or modified sequence opt4 from hemagglutinin__InfluenzaA__AEX36201

SEQ ID NO: 160624 - RNA, 1701 nt, Artificial Sequence
  derived and/or modified sequence opt4 from hemagglutinin__InfluenzaA__AEX36212
augaagaccaucaucgcccugagcuacauccugugccugguguucgcccagaagcugcccggcaucgacaacagcaccgccacccugugccugggccaccacgccgugcccaacggcaccaucgugaagaccaucaccaacgaccagaucgaggugaccaacgccaccgagcuggugcagaacagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaggcagcaacaacagcuucuucagcagacugaacuggcugacccacagcaaguucaaguaccccgcccugaacgugaccaugcccaacaacgaggaguucgacaagcuguacaucuggggcgugcaccaccccggcaccgacaacgaccagaucuuccuguacgcccaggccagcggcagaaucaccgugagcaccaagaucagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160625 - RNA, 1701 nt, Artificial Sequence; identical to SEQ ID NO: 160498
  derived and/or modified sequence opt4 from hemagglutinin__InfluenzaA__AEX36223

SEQ ID NO: 160626 - RNA, 1701 nt, Artificial Sequence
  derived and/or modified sequence opt4 from hemagglutinin__InfluenzaA__AEX36234
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaggcagcgacaacagcuucuucagcaagcugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugccugaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160627 - RNA, 1701 nt, Artificial Sequence
  derived and/or modified sequence opt4 from hemagglutinin__InfluenzaA__AEX36245
augaagaccaucaucgcccugagcuacauccugugccugguguucgcccagaagcugcccggcaucgacaacagcaccgccacccugugccugggccaccacgccgugcccaacggcaccaucgugaagaccaucaccaacgaccagaucgaggugaccaacgccaccgagcuggugcagaacagcagcaccggcggcaucugcgacagcccccaccagauccuggacggcgagaacugcacccugaucgacgcccugcugggcgacccccagugcgacggcuuccagaacaagaagugggaccuguucguggagagaagcaagaccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaggcagcaacaacagcuucuucagcagacugaacuggcugacccacagcaaguucaaguaccccgcccugaacgugaccaugcccaacaacgaggaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160628 - RNA, 1701 nt, Artificial Sequence
  derived and/or modified sequence opt4 from hemagglutinin__InfluenzaA__AEX36256
augaagaccaucaucgcccugagcuacauccugugccugguguucacccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaaagagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160629 - RNA, 1701 nt, Artificial Sequence; identical to SEQ ID NO: 160498
  derived and/or modified sequence opt4 from hemagglutinin__InfluenzaA__AEX36267

SEQ ID NO: 160630 - RNA, 1701 nt, Artificial Sequence
  derived and/or modified sequence opt4 from hemagglutinin__InfluenzaA__AEX36289
augaagaccaucaucgcccugagcuacauccugugccugguguucgcccagaagcugcccggcaucgacaacagcaccgccacccugugccugggccaccacgccgugcccaacggcaccaucgugaagaccaucaccaacgaccagaucgaggugaccaacgccaccgagcuggugcagaacagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaggcagcaacaacagcuucuucagcagacugaacuggcugacccacagcaaguucaaguaccccgcccugaacgugaccaugcccaacaacgaggaguucgacaagcuguacaucuggggcgugcaccaccccggcaccgacaacgaccagaucuuccuguacgcccaggccagcggcagaaucaccgugagcaccaagaucagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuacagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagcugggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160631 - RNA, 1701 nt, Artificial Sequence
  derived and/or modified sequence opt4 from hemagglutinin__InfluenzaA__AEX36300
augaagaccaucaucgcccugagcuacauccugugccugguguucgcccagaagcugcccggcaucgacaacagcaccgccacccugugccugggccaccacgccgugcccaacggcaccaucgugaagaccaucaccaacgaccagaucgaggugaccaacgccaccgagcuggugcagaacagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucagcaacgagagcuucaacuggaccggcgugacccagaacggcaccagcagcgccugcaagagaggcagcaacaacagcuucuucagcaagcugaacuggcugacccacagcaaguucaaguaccccgcccugaacgugaccaugcccaacaacgaggaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160632 - RNA, 1701 nt, Artificial Sequence
  derived and/or modified sequence opt4 from hemagglutinin__InfluenzaA__AEX36311
augaagaccaucaucgcccugagcuacauccugugccugguguucgcccagaagcugcccggcaucgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaagagaggcagcaacaacagcuucuucagcagacugaacuggcugacccaccugaaguucaaguaccccgcccugaacgugaccaugcccaacaacgaggaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160633 - RNA, 1701 nt, Artificial Sequence
  derived and/or modified sequence opt4 from hemagglutinin__InfluenzaA__AEX36322
augaagaccaucaucgcccugagcuacauccugugccugguguucgcccagaagcugcccggcaucgacaacagcaccgccacccugugccugggccaccacgccgugcccaacggcaccaucgugaagaccaucaccaacgaccagaucgaggugaccaacgccaccgagcuggugcagaacagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaggcagcaacaacagcuucuucagcagacugaacuggcugacccacagcaaguucaaguaccccgcccugaacgugaccaugcccaacaacgaggaguucgacaagcuguacaucuggggcgugcaccaccccggcaccgacaacgaccagaucuuccccuacgcccaggccagcggcagaaucaccgugagcaccaagaucagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgcccugcugggcuucaucaugugggccugccagaagggcaacaucagaugcaacaucugcaucuga

SEQ ID NO: 160634 - RNA, 1701 nt, Artificial Sequence
  derived and/or modified sequence opt4 from hemagglutinin__InfluenzaA__AEX36333
augaagaccaucaucgcccugagcuacauccugugccugguguucgcccagaagcugcccggcaucgacaacagcaccgccacccugugccugggccaccacgccgugcccaacggcaccaucgugaagaccaucaccaacgaccagaucgaggugaccaacgccaccgagcuggugcagaacagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaggcagcaacaacagcuucuucagcagacugaacuggcugacccacagcaaguucaaguaccccgcccugaacgugaccaugcccaacaacgaggaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacgccuacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160635 - RNA, 1701 nt, Artificial Sequence
  derived and/or modified sequence opt4 from hemagglutinin__InfluenzaA__AEX36344
augaagaccaucaucgcccugagcuacauccugugccugguguucgcccagaagcugcccggcaucgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaacgccuacagcaacugcuaccccuacgacgugcccgacuacgccagccugagaagccugguggccagcagcggcacccuggaguucaacaacgagagcuucaacugggccggcgugacccagaacggcaccagcagcgccugcaagagaggcagcaacaacagcuucuucagcagacugaacuggcugacccaccugaaguucaaguaccccgcccugaacgugaccaugcccaacaacgaggaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucgagagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160636 - RNA, 1701 nt, Artificial Sequence
  derived and/or modified sequence opt4 from hemagglutinin__InfluenzaA__AEX36366
augaagaccaucaucgcccugagcuacauccugugccugguguucgcccagaagcugagcggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160637 - RNA, 1701 nt, Artificial Sequence; identical to SEQ ID NO: 154448
  derived and/or modified sequence opt4 from hemagglutinin__InfluenzaA__AEX36377

SEQ ID NO: 160638 - RNA, 1701 nt, Artificial Sequence
  derived and/or modified sequence opt4 from hemagglutinin__InfluenzaA__AEX36388
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160639 - RNA, 1701 nt, Artificial Sequence
  derived and/or modified sequence opt4 from hemagglutinin__InfluenzaA__AEX36399
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaccgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160640 - RNA, 1701 nt, Artificial Sequence
  derived and/or modified sequence opt4 from hemagglutinin__InfluenzaA__AEX36410
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160641 - RNA, 1701 nt, Artificial Sequence; identical to SEQ ID NO: 154954
  derived and/or modified sequence opt4 from hemagglutinin__InfluenzaA__AEX36421

SEQ ID NO: 160642 - RNA, 1701 nt, Artificial Sequence
  derived and/or modified sequence opt4 from hemagglutinin__InfluenzaA__AEX36432
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccaggugcuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160643 - RNA, 1701 nt, Artificial Sequence
  derived and/or modified sequence opt4 from hemagglutinin__InfluenzaA__AEX36443
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgaggaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160644 - RNA, 1701 nt, Artificial Sequence
  derived and/or modified sequence opt4 from hemagglutinin__InfluenzaA__AEX36454
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgaggaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 160645 - RNA, 1701 nt, Artificial Sequence; identical to SEQ ID NO: 154249
  derived and/or modified sequence opt4 from hemagglutinin__InfluenzaA__AEX36465

SEQ ID NO: 160646 - RNA, 1701 nt, Artificial Sequence
  derived and/or modified sequence opt4 from hemagglutinin__InfluenzaA__AEX36476
augaagaccaucaucgcccugagcuacauccugugccugguguucgcccagaagcugcccggcaucgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaggcagcaacaacagcuucuucagcagacugaacuggcugacccacagcaaguucaaguaccccgcccugaacgugaccaugcccaacaacgaggaguucgacaagcuguacaucuggggcgugcaccaccccggcaccgacaacgaccagaucuuccccuacgcccaggccagcggcagaaucaccgugagcaccaagagaagccagcagaccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcgacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160647 - RNA, 1701 nt, Artificial Sequence
  derived and/or modified sequence opt4 from hemagglutinin__InfluenzaA__AEX36487
augaagaccaucaucgcccugagcuacauccugugccugguguucgcccagaagcugcccggcaucgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaggcagcaacaacagcuucuucagcagacugaacuggcugacccacagcaaguucaaguaccccgcccugaacgugaccaugcccaacaacgaggaguucgacaagcuguacaucuggggcgugcugcaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160648 - RNA, 1701 nt, Artificial Sequence; identical to SEQ ID NO: 160498
  derived and/or modified sequence opt4 from hemagglutinin__InfluenzaA__AEX36498

SEQ ID NO: 160649 - RNA, 1701 nt, Artificial Sequence
  derived and/or modified sequence opt4 from hemagglutinin__InfluenzaA__AEX36509
augaagaccaucaucgcccugagcuacauccugugccugguguucgcccagaagcugcccggcaucgacaacagcaccgccacccugugccugggccaccacgccgugcccaacggcaccaucgugaagaccaucaccaacgaccagaucgaggugaccaacgccaccgagcuggugcagaacagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaggcagcaacaacagcuucuucagcagacugaacuggcugacccacagcaaguucaaguaccccgcccugaacgugaccaugcccaacaacgaggaguucgacaagcuguacaucuggggcgugcaccaccccggcaccgacaacgaccagaucuuccccuacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160650 - RNA, 1701 nt, Artificial Sequence
  derived and/or modified sequence opt4 from hemagglutinin__InfluenzaA__AEX36520
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160651 - RNA, 1701 nt, Artificial Sequence
  derived and/or modified sequence opt4 from hemagglutinin__InfluenzaA__AEX36531
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggacaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160652 - RNA, 1701 nt, Artificial Sequence
  derived and/or modified sequence opt4 from hemagglutinin__InfluenzaA__AEX36542
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160653 - RNA, 1701 nt, Artificial Sequence; identical to SEQ ID NO: 160652
  derived and/or modified sequence opt4 from hemagglutinin__InfluenzaA__AEX36553

SEQ ID NO: 160654 - RNA, 1701 nt, Artificial Sequence; identical to SEQ ID NO: 160652
  derived and/or modified sequence opt4 from hemagglutinin__InfluenzaA__AEX36564

SEQ ID NO: 160655 - RNA, 1701 nt, Artificial Sequence
  derived and/or modified sequence opt4 from hemagglutinin__InfluenzaA__AEX36575
augaagaccaucaucgcccugagcuacauccugugccugguguucgcccagaagcugcccggcaacggcaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgacaucuggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160656 - RNA, 1701 nt, Artificial Sequence
  derived and/or modified sequence opt4 from hemagglutinin__InfluenzaA__AEX36586
augaagaccaucaucgcccugagcuacauccugugccugguguucgcccagaagcugcccggcaacgacaacaacaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160657 - RNA, 1701 nt, Artificial Sequence
  derived and/or modified sequence opt4 from hemagglutinin__InfluenzaA__AEX36597
augaagaccaucaucgcccugagcuacauccugugccugguguucgcccagaagcugcccggcaacgacaacagcauggccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagguggaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160658 - RNA, 1701 nt, Artificial Sequence
  derived and/or modified sequence opt4 from hemagglutinin__InfluenzaA__AEX36608
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagaacuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaagagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160659 - RNA, 1701 nt, Artificial Sequence; identical to SEQ ID NO: 160481
  derived and/or modified sequence opt4 from hemagglutinin__InfluenzaA__AEX36619

SEQ ID NO: 160660 - RNA, 1701 nt, Artificial Sequence
  derived and/or modified sequence opt4 from hemagglutinin__InfluenzaA__AEX63617
auggaggccaagcuguucgugcuguucugcgccuucaccgcccugaaggccgacaccaucugcgugggcuaccacgccaacaacagcaccgacaccguggacaccauccuggagaagaacgugaccgugacccacagcgugaaccugcuggagaacagccacaacggcaagcugugcagccugaacggcaagaucccccugcagcugggcaacugcaacguggccggcuggauccugggcaaccccaagugcgaccugcugcugaccgccaacagcuggagcuacaucaucgagaccagcaacagcaagaacggcgccugcuaccccggcgaguucgccgacuacgaggagcugaaggagcagcugagcaccgugagcagcuucgagagauucgagaucuuccccaaggccaccagcuggcccaaccacgacaccaccagaggcaccaccguggccugcagccacagcggcgccaacagcuucuacagaaaccugcuguggaucgugaagaagggcaacagcuaccccaagcugagcaagagcuacaccaacaacaagggcaaggaggugcuggugaucuggggcgugcaccacccccccaccgacagcgugcagcagacccuguaccagaacaaccacaccuacgugagcgugggcagcagcaaguacuacaagagauucacccccgagaucguggccagacccaaggugagagagcaggccggcagaaugaacuacuacuggacccugcuggaccagggcgacaccaucaccuucgaggccaccggcaaccugaucgcccccuggcacgccuucgcccugaagaagggcagcagcagcggcaucaugagaagcgacgcccaggugcacaacugcaccaccaagugccagaccccccacggcgcccugaagggcaaccugcccuuccagaacgugcaccccgugaccaucggcgagugccccaaguacgugaagagcacccagcugagaauggccaccggccugagaaacauccccagcauccagagcagaggccuguucggcgccaucgccggcuucaucgagggcggcuggaccggcaugguggacggcugguacggcuaccaccacagaaacgagcagggcagcggcuacgccgccgaccagaagagcacccagaucgccaucgacggcaucagcaacaaggugaacagcgugaucgagaagaugaacauccaguucaccagcgugggcaaggaguucaacagccuggagaagagaauggagaaccugaacaagaagguggacgacggcuuccuggacguguggaccuacaacgccgagcugcugauccugcuggagaacgagagaacccuggacuuccacgaccugaacgugaagaaccuguacgagaaggugaagagccagcugagaaacaacgccaaggagaucggcaacggcugcuucgaguucuaccacaagugcgacaacgagugcauggagagcgugaagaacggcaccuacaacuaccugaaguacagcgaggagagcaagcugaacagagaggagaucgacggcgugaagcuggagagcaugggcauccaccagauccuggccaucuacagcaccguggccagcagccuggugcugcuggugagccugggcgccaucagcuucuggaugugcagcaacggcagccugcagugcagagugugcaucuga

SEQ ID NO: 160661 - RNA, 1698 nt, Artificial Sequence; identical to SEQ ID NO: 155798
  derived and/or modified sequence opt4 from hemagglutinin__InfluenzaA__AEX92873

SEQ ID NO: 160662 - RNA, 1701 nt, Artificial Sequence; identical to SEQ ID NO: 156353
  derived and/or modified sequence opt4 from hemagglutinin__InfluenzaA__AEY69088

SEQ ID NO: 160663 - RNA, 1701 nt, Artificial Sequence; identical to SEQ ID NO: 155950
  derived and/or modified sequence opt4 from hemagglutinin__InfluenzaA__AEY69098

SEQ ID NO: 160664 - RNA, 1701 nt, Artificial Sequence; identical to SEQ ID NO: 155931
  derived and/or modified sequence opt4 from hemagglutinin__InfluenzaA__AEY69120

SEQ ID NO: 160665 - RNA, 1701 nt, Artificial Sequence; identical to SEQ ID NO: 156133
  derived and/or modified sequence opt4 from hemagglutinin__InfluenzaA__AEY69131

SEQ ID NO: 160666 - RNA, 1701 nt, Artificial Sequence; identical to SEQ ID NO: 159508
  derived and/or modified sequence opt4 from hemagglutinin__InfluenzaA__AEY69153

SEQ ID NO: 160667 - RNA, 1701 nt, Artificial Sequence; identical to SEQ ID NO: 156133
  derived and/or modified sequence opt4 from hemagglutinin__InfluenzaA__AEY69164

SEQ ID NO: 160668 - RNA, 1701 nt, Artificial Sequence; identical to SEQ ID NO: 156133
  derived and/or modified sequence opt4 from hemagglutinin__InfluenzaA__AEY69175

SEQ ID NO: 160669 - RNA, 1701 nt, Artificial Sequence; identical to SEQ ID NO: 156133
  derived and/or modified sequence opt4 from hemagglutinin__InfluenzaA__AEY69186

SEQ ID NO: 160670 - RNA, 1701 nt, Artificial Sequence; identical to SEQ ID NO: 156133
  derived and/or modified sequence opt4 from hemagglutinin__InfluenzaA__AEY69197

SEQ ID NO: 160671 - RNA, 1701 nt, Artificial Sequence; identical to SEQ ID NO: 156133
  derived and/or modified sequence opt4 from hemagglutinin__InfluenzaA__AEY69208

SEQ ID NO: 160672 - RNA, 1701 nt, Artificial Sequence; identical to SEQ ID NO: 156133
  derived and/or modified sequence opt4 from hemagglutinin__InfluenzaA__AEY69219

SEQ ID NO: 160673 - RNA, 1701 nt, Artificial Sequence; identical to SEQ ID NO: 155931
  derived and/or modified sequence opt4 from hemagglutinin__InfluenzaA__AEY69258

SEQ ID NO: 160674 - RNA, 1701 nt, Artificial Sequence; identical to SEQ ID NO: 156133
  derived and/or modified sequence opt4 from hemagglutinin__InfluenzaA__AEY69269

SEQ ID NO: 160675 - RNA, 1701 nt, Artificial Sequence; identical to SEQ ID NO: 155931
  derived and/or modified sequence opt4 from hemagglutinin__InfluenzaA__AEY69291

SEQ ID NO: 160676 - RNA, 1701 nt, Artificial Sequence; identical to SEQ ID NO: 155931
  derived and/or modified sequence opt4 from hemagglutinin__InfluenzaA__AEY69302

SEQ ID NO: 160677 - RNA, 1701 nt, Artificial Sequence; identical to SEQ ID NO: 155931
  derived and/or modified sequence opt4 from hemagglutinin__InfluenzaA__AEY69313

SEQ ID NO: 160678 - RNA, 1701 nt, Artificial Sequence; identical to SEQ ID NO: 155931
  derived and/or modified sequence opt4 from hemagglutinin__InfluenzaA__AEY69785

SEQ ID NO: 160679 - RNA, 1701 nt, Artificial Sequence
  derived and/or modified sequence opt4 from hemagglutinin__InfluenzaA__AEY69807
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggccugcagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgccauccccaacaucggcagcagacccagagugagaaacauccccagcagaaucagcaucuacuggaccaucgugaagcccggcgacauccugcugaucaacagcaccggcaaccugaucgcccccagaggcuacuucaagcugagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160680 - RNA, 1701 nt, Artificial Sequence; identical to SEQ ID NO: 156133
  derived and/or modified sequence opt4 from hemagglutinin__InfluenzaA__AEY69818

SEQ ID NO: 160681 - RNA, 1701 nt, Artificial Sequence; identical to SEQ ID NO: 156133
  derived and/or modified sequence opt4 from hemagglutinin__InfluenzaA__AEY69829

SEQ ID NO: 160682 - RNA, 1701 nt, Artificial Sequence; identical to SEQ ID NO: 156133
  derived and/or modified sequence opt4 from hemagglutinin__InfluenzaA__AEY69840

SEQ ID NO: 160683 - RNA, 1701 nt, Artificial Sequence; identical to SEQ ID NO: 156133
  derived and/or modified sequence opt4 from hemagglutinin__InfluenzaA__AEY69851

SEQ ID NO: 160684 - RNA, 1701 nt, Artificial Sequence; identical to SEQ ID NO: 156133
  derived and/or modified sequence opt4 from hemagglutinin__InfluenzaA__AEY69873

SEQ ID NO: 160685 - RNA, 1701 nt, Artificial Sequence; identical to SEQ ID NO: 156133
  derived and/or modified sequence opt4 from hemagglutinin__InfluenzaA__AEY69884

SEQ ID NO: 160686 - RNA, 1701 nt, Artificial Sequence; identical to SEQ ID NO: 156133
  derived and/or modified sequence opt4 from hemagglutinin__InfluenzaA__AEY69895

SEQ ID NO: 160687 - RNA, 1701 nt, Artificial Sequence; identical to SEQ ID NO: 159508
  derived and/or modified sequence opt4 from hemagglutinin__InfluenzaA__AEY69906

SEQ ID NO: 160688 - RNA, 1701 nt, Artificial Sequence; identical to SEQ ID NO: 156133
  derived and/or modified sequence opt4 from hemagglutinin__InfluenzaA__AEY69917

SEQ ID NO: 160689 - RNA, 1701 nt, Artificial Sequence
  derived and/or modified sequence opt4 from hemagglutinin__InfluenzaA__AEY69939
augaagaccaucaucgcccugagcuacauccugugccugguguucgcccagaagauccccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgccauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcggcugcaucacccccaacggcagcauccccaacgacaagcccuuccagaacgugaacagaaucaccuacggcgugugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacugguuccuguggaucagcuucgccaucagcugcuuccugcugugcguggcccugcugggcuucaucaugugggccugccagaagggcaacaucagaugcaacaucugcaucuga

SEQ ID NO: 160690 - RNA, 1701 nt, Artificial Sequence; identical to SEQ ID NO: 160689
  derived and/or modified sequence opt4 from hemagglutinin__InfluenzaA__AEY69950

SEQ ID NO: 160691 - RNA, 1701 nt, Artificial Sequence; identical to SEQ ID NO: 160689
  derived and/or modified sequence opt4 from hemagglutinin__InfluenzaA__AEY69961

SEQ ID NO: 160692 - RNA, 1701 nt, Artificial Sequence
  derived and/or modified sequence opt4 from hemagglutinin__InfluenzaA__AEY69994
augaagaccaucaucgcccugagcuacauccugugccugguguucgcccagaagauccccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgccauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcggcugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacugguuccuguggaucagcuucgccaucagcugcuuccugcugugcguggcccugcugggcuucaucaugugggccugccagaagggcaacaucagaugcaacaucugcaucuga

SEQ ID NO: 160693 - RNA, 1701 nt, Artificial Sequence; identical to SEQ ID NO: 160692
  derived and/or modified sequence opt4 from hemagglutinin__InfluenzaA__AEY70005

SEQ ID NO: 160694 - RNA, 1701 nt, Artificial Sequence; identical to SEQ ID NO: 156133
  derived and/or modified sequence opt4 from hemagglutinin__InfluenzaA__AEY70016

SEQ ID NO: 160695 - RNA, 1701 nt, Artificial Sequence
  derived and/or modified sequence opt4 from hemagglutinin__InfluenzaA__AEY70256
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacggcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgccauccccaacaucggcagcagacccagagugagaaacauccccagcagaaucagcaucuacuggaccaucgugaagcccggcgacaugcugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160696 - RNA, 1701 nt, Artificial Sequence; identical to SEQ ID NO: 156133
  derived and/or modified sequence opt4 from hemagglutinin__InfluenzaA__AEY70267

SEQ ID NO: 160697 - RNA, 1701 nt, Artificial Sequence; identical to SEQ ID NO: 156133
  derived and/or modified sequence opt4 from hemagglutinin__InfluenzaA__AEY70278

SEQ ID NO: 160698 - RNA, 1701 nt, Artificial Sequence; identical to SEQ ID NO: 155931
  derived and/or modified sequence opt4 from hemagglutinin__InfluenzaA__AEY70289

SEQ ID NO: 160699 - RNA, 1701 nt, Artificial Sequence; identical to SEQ ID NO: 156133
  derived and/or modified sequence opt4 from hemagglutinin__InfluenzaA__AEY70300

SEQ ID NO: 160700 - RNA, 1701 nt, Artificial Sequence; identical to SEQ ID NO: 156133
  derived and/or modified sequence opt4 from hemagglutinin__InfluenzaA__AEY70311

SEQ ID NO: 160701 - RNA, 1701 nt, Artificial Sequence; identical to SEQ ID NO: 156133
  derived and/or modified sequence opt4 from hemagglutinin__InfluenzaA__AEY70333

SEQ ID NO: 160702 - RNA, 1701 nt, Artificial Sequence; identical to SEQ ID NO: 160692
  derived and/or modified sequence opt4 from hemagglutinin__InfluenzaA__AEY70344

SEQ ID NO: 160703 - RNA, 1701 nt, Artificial Sequence; identical to SEQ ID NO: 157744
  derived and/or modified sequence opt4 from hemagglutinin__InfluenzaA__AEY70355

SEQ ID NO: 160704 - RNA, 1701 nt, Artificial Sequence; identical to SEQ ID NO: 155931
  derived and/or modified sequence opt4 from hemagglutinin__InfluenzaA__AEY70365

SEQ ID NO: 160705 - RNA, 1701 nt, Artificial Sequence; identical to SEQ ID NO: 156133
  derived and/or modified sequence opt4 from hemagglutinin__InfluenzaA__AEY70376

SEQ ID NO: 160706 - RNA, 1701 nt, Artificial Sequence
  derived and/or modified sequence opt4 from hemagglutinin__InfluenzaA__AFB18656
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagacccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagagacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccgccgccagcagccuggugcugguggugagccugggcgccaucagcuucuggaugugcagcaacggcagccugcagugcagaaucugcaucuga

SEQ ID NO: 160707 - RNA, 1701 nt, Artificial Sequence; identical to SEQ ID NO: 159570
  derived and/or modified sequence opt4 from hemagglutinin__InfluenzaA__AFB40597

SEQ ID NO: 160708 - RNA, 1701 nt, Artificial Sequence; identical to SEQ ID NO: 159570
  derived and/or modified sequence opt4 from hemagglutinin__InfluenzaA__AFB40598

SEQ ID NO: 160709 - RNA, 1701 nt, Artificial Sequence
  derived and/or modified sequence opt4 from hemagglutinin__InfluenzaA__AFB40599
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgaccugaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160710 - RNA, 1701 nt, Artificial Sequence; identical to SEQ ID NO: 156353
  derived and/or modified sequence opt4 from hemagglutinin__InfluenzaA__AFB40600

SEQ ID NO: 160711 - RNA, 1701 nt, Artificial Sequence
  derived and/or modified sequence opt4 from hemagglutinin__InfluenzaA__AFB40601
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccgagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagaggccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160712 - RNA, 1701 nt, Artificial Sequence; identical to SEQ ID NO: 155189
  derived and/or modified sequence opt4 from hemagglutinin__InfluenzaA__AFB40602

SEQ ID NO: 160713 - RNA, 1701 nt, Artificial Sequence; identical to SEQ ID NO: 156353
  derived and/or modified sequence opt4 from hemagglutinin__InfluenzaA__AFB40603

SEQ ID NO: 160714 - RNA, 1701 nt, Artificial Sequence
  derived and/or modified sequence opt4 from hemagglutinin__InfluenzaA__AFB40604
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaaggagggcaacagcuaccccaagcugagcaagagcuacaucaacgacaagggcaaggaggugcuggugcuguggggcauccaccacccccccaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccguggacaaggaguucaaccaccuggagaagagaaucggcaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160715 - RNA, 1701 nt, Artificial Sequence; identical to SEQ ID NO: 155189
  derived and/or modified sequence opt4 from hemagglutinin__InfluenzaA__AFB70138

SEQ ID NO: 160716 - RNA, 1701 nt, Artificial Sequence
  derived and/or modified sequence opt4 from hemagglutinin__InfluenzaA__AFB70145
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcaucaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160717 - RNA, 1701 nt, Artificial Sequence
  derived and/or modified sequence opt4 from hemagglutinin__InfluenzaA__AFB70154
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacgagaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160718 - RNA, 1701 nt, Artificial Sequence; identical to SEQ ID NO: 155189
  derived and/or modified sequence opt4 from hemagglutinin__InfluenzaA__AFB70156

SEQ ID NO: 160719 - RNA, 1701 nt, Artificial Sequence; identical to SEQ ID NO: 155189
  derived and/or modified sequence opt4 from hemagglutinin__InfluenzaA__AFB70158

SEQ ID NO: 160720 - RNA, 1701 nt, Artificial Sequence; identical to SEQ ID NO: 160716
  derived and/or modified sequence opt4 from hemagglutinin__InfluenzaA__AFB70160

SEQ ID NO: 160721 - RNA, 1701 nt, Artificial Sequence; identical to SEQ ID NO: 156383
  derived and/or modified sequence opt4 from hemagglutinin__InfluenzaA__AFB70162

SEQ ID NO: 160722 - RNA, 1701 nt, Artificial Sequence
  derived and/or modified sequence opt4 from hemagglutinin__InfluenzaA__AFB70167
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaugagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160723 - RNA, 1701 nt, Artificial Sequence; identical to SEQ ID NO: 155189
  derived and/or modified sequence opt4 from hemagglutinin__InfluenzaA__AFB70177

SEQ ID NO: 160724 - RNA, 1701 nt, Artificial Sequence; identical to SEQ ID NO: 155758
  derived and/or modified sequence opt4 from hemagglutinin__InfluenzaA__AFB70187

SEQ ID NO: 160725 - RNA, 1701 nt, Artificial Sequence; identical to SEQ ID NO: 156383
  derived and/or modified sequence opt4 from hemagglutinin__InfluenzaA__AFB70197

SEQ ID NO: 160726 - RNA, 1701 nt, Artificial Sequence; identical to SEQ ID NO: 155189
  derived and/or modified sequence opt4 from hemagglutinin__InfluenzaA__AFB70207

SEQ ID NO: 160727 - RNA, 1701 nt, Artificial Sequence; identical to SEQ ID NO: 155189
  derived and/or modified sequence opt4 from hemagglutinin__InfluenzaA__AFB70217

SEQ ID NO: 160728 - RNA, 1701 nt, Artificial Sequence; identical to SEQ ID NO: 155189
  derived and/or modified sequence opt4 from hemagglutinin__InfluenzaA__AFB70227

SEQ ID NO: 160729 - RNA, 1701 nt, Artificial Sequence
  derived and/or modified sequence opt4 from hemagglutinin__InfluenzaA__AFB70247
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaaggaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160730 - RNA, 1701 nt, Artificial Sequence
  derived and/or modified sequence opt4 from hemagglutinin__InfluenzaA__AFB70257
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucguggacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160731 - RNA, 1701 nt, Artificial Sequence; identical to SEQ ID NO: 159596
  derived and/or modified sequence opt4 from hemagglutinin__InfluenzaA__AFB70267

SEQ ID NO: 160732 - RNA, 1701 nt, Artificial Sequence; identical to SEQ ID NO: 155659
  derived and/or modified sequence opt4 from hemagglutinin__InfluenzaA__AFB70277

SEQ ID NO: 160733 - RNA, 1701 nt, Artificial Sequence; identical to SEQ ID NO: 155189
  derived and/or modified sequence opt4 from hemagglutinin__InfluenzaA__AFB70287

SEQ ID NO: 160734 - RNA, 1701 nt, Artificial Sequence; identical to SEQ ID NO: 155189
  derived and/or modified sequence opt4 from hemagglutinin__InfluenzaA__AFB70297

SEQ ID NO: 160735 - RNA, 1701 nt, Artificial Sequence; identical to SEQ ID NO: 155189
  derived and/or modified sequence opt4 from hemagglutinin__InfluenzaA__AFB70307

SEQ ID NO: 160736 - RNA, 1701 nt, Artificial Sequence; identical to SEQ ID NO: 160716
  derived and/or modified sequence opt4 from hemagglutinin__InfluenzaA__AFB70317

SEQ ID NO: 160737 - RNA, 1701 nt, Artificial Sequence
  derived and/or modified sequence opt4 from hemagglutinin__InfluenzaA__AFB70327
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccugggcaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160738 - RNA, 1701 nt, Artificial Sequence; identical to SEQ ID NO: 155189
  derived and/or modified sequence opt4 from hemagglutinin__InfluenzaA__AFB70337

SEQ ID NO: 160739 - RNA, 1701 nt, Artificial Sequence; identical to SEQ ID NO: 157159
  derived and/or modified sequence opt4 from hemagglutinin__InfluenzaA__AFB70347

SEQ ID NO: 160740 - RNA, 1701 nt, Artificial Sequence; identical to SEQ ID NO: 155189
  derived and/or modified sequence opt4 from hemagglutinin__InfluenzaA__AFB70367

SEQ ID NO: 160741 - RNA, 1701 nt, Artificial Sequence; identical to SEQ ID NO: 155189
  derived and/or modified sequence opt4 from hemagglutinin__InfluenzaA__AFB70377

SEQ ID NO: 160742 - RNA, 1701 nt, Artificial Sequence; identical to SEQ ID NO: 155758
  derived and/or modified sequence opt4 from hemagglutinin__InfluenzaA__AFB70387

SEQ ID NO: 160743 - RNA, 1701 nt, Artificial Sequence; identical to SEQ ID NO: 155189
  derived and/or modified sequence opt4 from hemagglutinin__InfluenzaA__AFB70397

SEQ ID NO: 160744 - RNA, 1701 nt, Artificial Sequence; identical to SEQ ID NO: 155189
  derived and/or modified sequence opt4 from hemagglutinin__InfluenzaA__AFB70407

SEQ ID NO: 160745 - RNA, 1701 nt, Artificial Sequence
  derived and/or modified sequence opt4 from hemagglutinin__InfluenzaA__AFB77618
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcaucgccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccaccaccaccggcgaccagcagagccuguaccagaacgccgacggcuacguguucgugggcaccaccagauacagcaagaaguucaagcccgagaucggcaucagacccaaggugaaggaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugaugguggugagccugggcgccaucagcuucuggaugugcagcaacggcagccugcagugcagaaucugcaucuga

SEQ ID NO: 160746 - RNA, 1701 nt, Artificial Sequence; identical to SEQ ID NO: 159387
  derived and/or modified sequence opt4 from hemagglutinin__InfluenzaA__AFB77619

SEQ ID NO: 160747 - RNA, 1701 nt, Artificial Sequence; identical to SEQ ID NO: 159387
  derived and/or modified sequence opt4 from hemagglutinin__InfluenzaA__AFB77620

SEQ ID NO: 160748 - RNA, 1701 nt, Artificial Sequence
  derived and/or modified sequence opt4 from hemagglutinin__InfluenzaA__AFB77621
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcgugaccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160749 - RNA, 1701 nt, Artificial Sequence
  derived and/or modified sequence opt4 from hemagglutinin__InfluenzaA__AFB77622
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgaccccaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160750 - RNA, 1701 nt, Artificial Sequence; identical to SEQ ID NO: 159387
  derived and/or modified sequence opt4 from hemagglutinin__InfluenzaA__AFB77623

SEQ ID NO: 160751 - RNA, 1701 nt, Artificial Sequence; identical to SEQ ID NO: 159387
  derived and/or modified sequence opt4 from hemagglutinin__InfluenzaA__AFB77624

SEQ ID NO: 160752 - RNA, 1701 nt, Artificial Sequence
  derived and/or modified sequence opt4 from hemagglutinin__InfluenzaA__AFB77625
augaaggccauccugguggugcugcuguacaccuucaccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160753 - RNA, 1701 nt, Artificial Sequence
  derived and/or modified sequence opt4 from hemagglutinin__InfluenzaA__AFB77627
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuucagcaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160754 - RNA, 1701 nt, Artificial Sequence; identical to SEQ ID NO: 159387
  derived and/or modified sequence opt4 from hemagglutinin__InfluenzaA__AFB77628

SEQ ID NO: 160755 - RNA, 1701 nt, Artificial Sequence
  derived and/or modified sequence opt4 from hemagglutinin__InfluenzaA__AFB77629
augaaggccauccugguggugcugcuguacaccuucaccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgaggagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160756 - RNA, 1701 nt, Artificial Sequence
  derived and/or modified sequence opt4 from hemagglutinin__InfluenzaA__AFB77630
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgagagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160757 - RNA, 1701 nt, Artificial Sequence
  derived and/or modified sequence opt4 from hemagglutinin__InfluenzaA__AFB77631
augaaggccauccugguggugcugcuguacaccuucaccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaccaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160758 - RNA, 1701 nt, Artificial Sequence
  derived and/or modified sequence opt4 from hemagglutinin__InfluenzaA__AFB77632
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugaccaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcaagaucugcaucuga

SEQ ID NO: 160759 - RNA, 1701 nt, Artificial Sequence
  derived and/or modified sequence opt4 from hemagglutinin__InfluenzaA__AFB77633
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcagccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugaagaaccagcugaagaacaacgccaaggagaucggcaacggcugcuucgaguucuaccacaagugcgacaacacccccaucaagaacgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160760 - RNA, 1701 nt, Artificial Sequence
  derived and/or modified sequence opt4 from hemagglutinin__InfluenzaA__AFB77634
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgagaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160761 - RNA, 1701 nt, Artificial Sequence
  derived and/or modified sequence opt4 from hemagglutinin__InfluenzaA__AFB77635
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagccccuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160762 - RNA, 1701 nt, Artificial Sequence
  derived and/or modified sequence opt4 from hemagglutinin__InfluenzaA__AFB77636
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaaggccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugaugguggugagccugggcgccaucagcuucuggaugugcagcaacggcagccugcagugcagaaucugcaucuga

SEQ ID NO: 160763 - RNA, 1701 nt, Artificial Sequence
  derived and/or modified sequence opt4 from hemagglutinin__InfluenzaA__AFB77637
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaagggcagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160764 - RNA, 1701 nt, Artificial Sequence
  derived and/or modified sequence opt4 from hemagglutinin__InfluenzaA__AFB77638
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaaguucuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160765 - RNA, 1701 nt, Artificial Sequence; identical to SEQ ID NO: 159387
  derived and/or modified sequence opt4 from hemagglutinin__InfluenzaA__AFB77639

SEQ ID NO: 160766 - RNA, 1701 nt, Artificial Sequence
  derived and/or modified sequence opt4 from hemagglutinin__InfluenzaA__AFB77640
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagggccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160767 - RNA, 1701 nt, Artificial Sequence
  derived and/or modified sequence opt4 from hemagglutinin__InfluenzaA__AFB77641
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaugugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160768 - RNA, 1701 nt, Artificial Sequence; identical to SEQ ID NO: 159387
  derived and/or modified sequence opt4 from hemagglutinin__InfluenzaA__AFB77642

SEQ ID NO: 160769 - RNA, 1701 nt, Artificial Sequence
  derived and/or modified sequence opt4 from hemagglutinin__InfluenzaA__AFB77643
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagcccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacgacaccaaggacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160770 - RNA, 1701 nt, Artificial Sequence
  derived and/or modified sequence opt4 from hemagglutinin__InfluenzaA__AFB77691
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgagaagcuguacaucuggggcgugcaccaccccggcaccgacaaggaccagaucuuccuguacgcccaggccagcggcagaaucaccgugagcaccaagagaagccagcaggccgugauccccaacaucggcagcagacugagagugagaaacauccccagcagaaucagcaucuacuggaccaucgugaagcccggcgacauccugcugaucaacagcaccggcaaccugaacgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaaccagcugagagagaacgccgaggacaugggcaacggcugcuucaagaucuaccacaagugcgacaacaccugcaucggcagcaucagaaacggcaccuacgaccacgacgccuacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160771 - RNA, 1701 nt, Artificial Sequence
  derived and/or modified sequence opt4 from hemagglutinin__InfluenzaA__AFB77692
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaccggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160772 - RNA, 1701 nt, Artificial Sequence; identical to SEQ ID NO: 160302
  derived and/or modified sequence opt4 from hemagglutinin__InfluenzaA__AFB77693

SEQ ID NO: 160773 - RNA, 1701 nt, Artificial Sequence
  derived and/or modified sequence opt4 from hemagglutinin__InfluenzaA__AFB77694
augaagaccaucaucgcccugagcuacauccugugccugguguucgcccagaagcugcccggcaacgacaacagcaccgccacccugugccugggccaccacgccgugcccaacggcaccaucgugaagaccaucgccaacgaccagaucgaggugaccaacgccaccgagcuggugcagaacagcagcaccggcgagaucugcgacagcccccaccagauccuggacggcgagaacugcacccugaucgacgcccugcugggcgacccccagugcgacgacuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacaccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160774 - RNA, 1701 nt, Artificial Sequence
  derived and/or modified sequence opt4 from hemagglutinin__InfluenzaA__AFB77695
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaccggcgagaucugcgacagcccccaccagauccuggacggcgagaacugcacccugaucgacgcccugcugggcgacccccagugcgacgacuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160775 - RNA, 1701 nt, Artificial Sequence
  derived and/or modified sequence opt4 from hemagglutinin__InfluenzaA__AFB78126
augaagaccaucaucgcccugagcuacauccugugccugguguucgcccagaagcugcccggcaacgacaacagcaccgccacccugugccugggccaccacgccgugagcaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccaggacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagcaucuacgcccaggccagcggcagagugaccgugagcaccaagagaagccagcagaccgugauccccaacaucggcagcagccccugggugagaggcgccagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaccaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 160776 - RNA, 1701 nt, Artificial Sequence
  derived and/or modified sequence opt4 from hemagglutinin__InfluenzaA__AFC34056
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagaacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160777 - RNA, 1701 nt, Artificial Sequence; identical to SEQ ID NO: 160776
  derived and/or modified sequence opt4 from hemagglutinin__InfluenzaA__AFC34057

SEQ ID NO: 160778 - RNA, 1701 nt, Artificial Sequence
  derived and/or modified sequence opt4 from hemagglutinin__InfluenzaA__AFD32426
augaaggccaaccugcuggugcugcugagcgcccuggccgccgccgacgccgacaccaucugcaucggcuaccacgccaacaacagcaccgacaccguggacaccgugcuggagaagaacgugaccgugacccacagcgugaaccugcuggaggacagccacaacggcaagcugugcaagcugagaggcguggccccccugcaccugggcaagugcaacaucgccggcagaauccugggcaaccccgagugcgagagccugagcaccgccagcagcuggagcuacaucguggagacccccagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacaccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaagugccagaccccccugggcgccaucaacagcagccugcccuaccagaacauccaccccgugaccaucggcgagugccccaaguacgugagaagcgccaagcugagaauggugaccggccugagaaacacccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacaccgugaucgagaagaugaacauccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcgacaacgagugcauggagagcgugagaaacggcaccuacgacuaccccaaguacagcgaggagagcaagcugaacagagagaagguggacggcgugaagcuggagagcaugggcaucuaccagauccuggccaucuacagcaccguggccagcagccuggugcugcuggugagccugggcgccaucagcuucuggaugugcagcaacggcagccugcagugcagaaucugcaucuga

SEQ ID NO: 160779 - RNA, 1698 nt, Artificial Sequence
  derived and/or modified sequence opt4 from hemagglutinin__InfluenzaA__AFD32427
augaaggccaaccugcuggugcugcugagcgcccuggccgccgccgacgccgacaccaucugcaucggcuaccacgccaacaacagcaccgacaccguggacaccgugcuggagaagaacgugaccgugacccacagcgugaaccugcuggaggacagccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgugaacgaccugugcuaccccggcgacuucaacgacuacgaggagcugaagcaccugcugagcagaaucaaccacuucgagaagauccagaucauccccaagagcagcuggagcagccacgaggccagccugggcgugagcagcgccugccccuaccagggcaagagcagcuucuucagaaacgugguguggcugaucaagaagaacagcaccuaccccaccaucaagagaagcuacaacaacaccaaccaggaggaccugcuggugcuguggggcauccaccaccccaacgacgccgccgagcagaccaagcuguaccagaaccccaccaccuacaucagcgugggcaccagcacccugaaccagagacuggugcccagaaucgccaccagaagcaaggugaacggccagagcggcagaauggaguucuucuggaccauccugaagcccaacgacgccaucaacuucgagagcaacggcaacuucaucgcccccgaguacgccuacaagaucgugaagaagggcgacagcaccaucaugaagagcgagcuggaguacggcaacugcaacaccaagugccagaccccccugggcgccaucaacagcagccugcccuaccagaacauccaccccgugaccaucggcgagugccccaaguacgugagaagcgccaagcugagaauggugaccggccugagaaacacccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacaccgugaucgagaagaugaacauccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcgacaacgagugcauggagagcgugagaaacggcaccuacgacuaccccaaguacagcgaggagagcaagcugaacagagagaagguggacggcgugaagcuggagagcaugggcaucuaccagauccuggccaucuacagcaccguggccagcagccuggugcugcuggugagccugggcgccaucagcuucuggaugugcagcaacggcagccugcagugcagaaucugcaucuga

SEQ ID NO: 160780 - RNA, 1722 nt, Artificial Sequence
  derived and/or modified sequence opt4 from hemagglutinin__InfluenzaA__AFD32428
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgaccuggacggcgugaagccccugauccugagagacugcagcguggccggcuggcugcugggcaaccccaugugcgacgaguucaucaacgugcccgaguggagcuacaucguggagaaggccaaccccgugaacgaccugugcuaccccggcgacuucaacgacuacgaggagcugaagcaccugcugagcagaaucaaccacuucgagaagauccagaucauccccaagagcagcuggagcagccacgaggccagccugggcgugagcagcgccugccccuaccagggcaagagcagcuucuucagaaacgugguguggcugaucaagaagaacagcaccuaccccaccaucaagagaagcuacaacaacaccaaccaggaggaccugcuggugcuguggggcauccaccaccccaacgacgccgccgagcagaccaagcuguaccagaaccccaccaccuacaucagcgugggcaccagcacccugaaccagagacuggugcccagaaucgccaccagaagcaaggugaacggccagagcggcagaauggaguucuucuggaccauccugaagcccaacgacgccaucaacuucgagagcaacggcaacuucaucgcccccgaguacgccuacaagaucgugaagaagggcgacagcaccaucaugaagagcgagcuggaguacggcaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160781 - RNA, 1704 nt, Artificial Sequence
  derived and/or modified sequence opt4 from hemagglutinin__InfluenzaA__AFD32429
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcacccagggcaagagacccaccgaccugggccagugcggccugcugggcacccugaucggccccccccagugcgaccaguuccuggaguucgacgccgaccugaucaucgagagaagagagggcaccgacgugugcuaccccggcaaguucaccaacgaggagagccugagacagauccugagaggcagcggcggcaucgacaaggagagcaugggcuucaccuacagcggcaucagaaccaacggcgccaccagcgccugcagaagaagcggcagcagcuucuacgccgagaugaaguggcugcugagcaacagcgacaacgccgaguucccccagaugaccaagagcuacagaaaccccagaaacaagcccgcccugaucaucuggggcgugcaccacagcggcagcgccaccgagcagaccaagcuguacggcagcggcaacaagcugaucaccgugggcagcagcaaguaccagcagagcuucacccccagccccggcgccagaccccaggugaacggccagagcggcagaaucgacuuccacuggcugcugcuggaccccaacgacaccgugaccuucaccuucaacggcgccuucaucgcccccgacagagccagcuucuucagaggcgagagccugggcgugcagagcgacgugccccuggacagcggcugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160782 - RNA, 1701 nt, Artificial Sequence; identical to SEQ ID NO: 152593
  derived and/or modified sequence opt4 from hemagglutinin__InfluenzaA__AFD63527

SEQ ID NO: 160783 - RNA, 1701 nt, Artificial Sequence
  derived and/or modified sequence opt4 from hemagglutinin__InfluenzaA__AFD63538
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagcaucguggccagcagcggcacccuggaguucaacaacgagagcuucaacuggaccggcgugacccagaacggcaccagcagcgccugcaagagaaagagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauaccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160784 - RNA, 1701 nt, Artificial Sequence
  derived and/or modified sequence opt4 from hemagglutinin__InfluenzaA__AFD63549
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaucagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160785 - RNA, 1701 nt, Artificial Sequence; identical to SEQ ID NO: 152593
  derived and/or modified sequence opt4 from hemagglutinin__InfluenzaA__AFD63571

SEQ ID NO: 160786 - RNA, 1701 nt, Artificial Sequence
  derived and/or modified sequence opt4 from hemagglutinin__InfluenzaA__AFD63615
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaaagagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggaggagagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160787 - RNA, 1701 nt, Artificial Sequence
  derived and/or modified sequence opt4 from hemagglutinin__InfluenzaA__AFD63626
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaucagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacaucagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160788 - RNA, 1701 nt, Artificial Sequence
  derived and/or modified sequence opt4 from hemagglutinin__InfluenzaA__AFD63637
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaucagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcaccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160789 - RNA, 1701 nt, Artificial Sequence
  derived and/or modified sequence opt4 from hemagglutinin__InfluenzaA__AFD63648
augaagaccaucaucgcccugagcuacauccugugccugguguucgcccagaagcugcccggcaacgacaacagcauggccacccugugccugggccaccacgccgugcccaacggcaccaucgugaagaccaucaccaacgaccagaucgaggugaccaacgccaccgagcuggugcagaucagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160790 - RNA, 1701 nt, Artificial Sequence; identical to SEQ ID NO: 152593
  derived and/or modified sequence opt4 from hemagglutinin__InfluenzaA__AFD63659

SEQ ID NO: 160791 - RNA, 1701 nt, Artificial Sequence
  derived and/or modified sequence opt4 from hemagglutinin__InfluenzaA__AFD63681
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaaagagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaaggugagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160792 - RNA, 1701 nt, Artificial Sequence
  derived and/or modified sequence opt4 from hemagglutinin__InfluenzaA__AFD63692
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcugcaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160793 - RNA, 1701 nt, Artificial Sequence
  derived and/or modified sequence opt4 from hemagglutinin__InfluenzaA__AFD63703
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaucagcagcaccagcggcaucugcgacagccccuaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagccagaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160794 - RNA, 1701 nt, Artificial Sequence
  derived and/or modified sequence opt4 from hemagglutinin__InfluenzaA__AFD63714
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaucagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcaccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcagaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccacaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160795 - RNA, 1701 nt, Artificial Sequence
  derived and/or modified sequence opt4 from hemagglutinin__InfluenzaA__AFD63736
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaucagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcaccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccacaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160796 - RNA, 1701 nt, Artificial Sequence
  derived and/or modified sequence opt4 from hemagglutinin__InfluenzaA__AFD63747
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccacagaaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160797 - RNA, 1701 nt, Artificial Sequence
  derived and/or modified sequence opt4 from hemagglutinin__InfluenzaA__AFD63758
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaaagagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160798 - RNA, 1701 nt, Artificial Sequence
  derived and/or modified sequence opt4 from hemagglutinin__InfluenzaA__AFD63769
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaucagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccacaucaagagcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160799 - RNA, 1701 nt, Artificial Sequence; identical to SEQ ID NO: 152593
  derived and/or modified sequence opt4 from hemagglutinin__InfluenzaA__AFD63780

SEQ ID NO: 160800 - RNA, 1701 nt, Artificial Sequence; identical to SEQ ID NO: 160797
  derived and/or modified sequence opt4 from hemagglutinin__InfluenzaA__AFD63791

SEQ ID NO: 160801 - RNA, 1701 nt, Artificial Sequence; identical to SEQ ID NO: 152593
  derived and/or modified sequence opt4 from hemagglutinin__InfluenzaA__AFD63802

SEQ ID NO: 160802 - RNA, 1701 nt, Artificial Sequence
  derived and/or modified sequence opt4 from hemagglutinin__InfluenzaA__AFD63813
augaagaccaucaucgcccugagcuacauccugagccugguguucgcccagaaguuccccggcaacgacaacagcaccgccacccugugccugggccaccacgccgugcccaacggcaccaucgugaagaccaucaccaacgaccagaucgaggugaccaacgccaccgagcuggugcagaucagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcagccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacaucagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaccagcugcuuccugcugugcguggcccugcugggcuucaucaugugggccugccagaagggcaacaucagaugcaacaucugcaucuga

SEQ ID NO: 160803 - RNA, 1701 nt, Artificial Sequence; identical to SEQ ID NO: 160787
  derived and/or modified sequence opt4 from hemagglutinin__InfluenzaA__AFD63824

SEQ ID NO: 160804 - RNA, 1701 nt, Artificial Sequence; identical to SEQ ID NO: 152593
  derived and/or modified sequence opt4 from hemagglutinin__InfluenzaA__AFD63846

SEQ ID NO: 160805 - RNA, 1701 nt, Artificial Sequence; identical to SEQ ID NO: 153831
  derived and/or modified sequence opt4 from hemagglutinin__InfluenzaA__AFD63857

SEQ ID NO: 160806 - RNA, 1701 nt, Artificial Sequence; identical to SEQ ID NO: 152593
  derived and/or modified sequence opt4 from hemagglutinin__InfluenzaA__AFD63868

SEQ ID NO: 160807 - RNA, 1701 nt, Artificial Sequence; identical to SEQ ID NO: 152593
  derived and/or modified sequence opt4 from hemagglutinin__InfluenzaA__AFD63890

SEQ ID NO: 160808 - RNA, 1701 nt, Artificial Sequence; identical to SEQ ID NO: 152593
  derived and/or modified sequence opt4 from hemagglutinin__InfluenzaA__AFD63901

SEQ ID NO: 160809 - RNA, 1701 nt, Artificial Sequence; identical to SEQ ID NO: 152593
  derived and/or modified sequence opt4 from hemagglutinin__InfluenzaA__AFD63912

SEQ ID NO: 160810 - RNA, 1701 nt, Artificial Sequence
  derived and/or modified sequence opt4 from hemagglutinin__InfluenzaA__AFD63923
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaaagagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacaucagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160811 - RNA, 1701 nt, Artificial Sequence
  derived and/or modified sequence opt4 from hemagglutinin__InfluenzaA__AFD63934
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgagagcgaccagaucagccuguacgcccaggccagcggcagaaucaccgugagcaccaagagaagccagcagaccgugauccccaacaucggcagcagacccagagugagagacgugagcagcagaaucagcaucuacuggaccguggugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160812 - RNA, 1701 nt, Artificial Sequence; identical to SEQ ID NO: 160787
  derived and/or modified sequence opt4 from hemagglutinin__InfluenzaA__AFD63945

SEQ ID NO: 160813 - RNA, 1701 nt, Artificial Sequence; identical to SEQ ID NO: 160787
  derived and/or modified sequence opt4 from hemagglutinin__InfluenzaA__AFD63956

SEQ ID NO: 160814 - RNA, 1701 nt, Artificial Sequence; identical to SEQ ID NO: 160787
  derived and/or modified sequence opt4 from hemagglutinin__InfluenzaA__AFD63967

SEQ ID NO: 160815 - RNA, 1701 nt, Artificial Sequence; identical to SEQ ID NO: 152593
  derived and/or modified sequence opt4 from hemagglutinin__InfluenzaA__AFD63989

SEQ ID NO: 160816 - RNA, 1701 nt, Artificial Sequence; identical to SEQ ID NO: 152593
  derived and/or modified sequence opt4 from hemagglutinin__InfluenzaA__AFD64000

SEQ ID NO: 160817 - RNA, 1701 nt, Artificial Sequence
  derived and/or modified sequence opt4 from hemagglutinin__InfluenzaA__AFD64011
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggcccccggcaagaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcgacaucugcaucuga

SEQ ID NO: 160818 - RNA, 1701 nt, Artificial Sequence; identical to SEQ ID NO: 152593
  derived and/or modified sequence opt4 from hemagglutinin__InfluenzaA__AFD64022

SEQ ID NO: 160819 - RNA, 1701 nt, Artificial Sequence; identical to SEQ ID NO: 152593
  derived and/or modified sequence opt4 from hemagglutinin__InfluenzaA__AFD64033

SEQ ID NO: 160820 - RNA, 1701 nt, Artificial Sequence
  derived and/or modified sequence opt4 from hemagglutinin__InfluenzaA__AFD64044
augaagaccaucaucgcccugagcuacauccugugccugguguucgcccagaagcugcccggcaacgagaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160821 - RNA, 1701 nt, Artificial Sequence; identical to SEQ ID NO: 160797
  derived and/or modified sequence opt4 from hemagglutinin__InfluenzaA__AFD64055

SEQ ID NO: 160822 - RNA, 1701 nt, Artificial Sequence
  derived and/or modified sequence opt4 from hemagglutinin__InfluenzaA__AFD64066
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacaccagccugagaagccugguggccagcagcggcacccuggaguucaacaacgagagcuucaacuggaccggcgugacccagaacggcaccagcagcgccugcaagagaagaagcaacaagagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacgugcccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacgccgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaagaacuggauccuguggaucagcuucgccaucagcugcuuccugcugugcguggcccugcugggcuucaucaugugggccugccagaagggcaacaucagaugcaacaucugcaucuga

SEQ ID NO: 160823 - RNA, 1701 nt, Artificial Sequence
  derived and/or modified sequence opt4 from hemagglutinin__InfluenzaA__AFD64077
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaucagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagaaucagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160824 - RNA, 1701 nt, Artificial Sequence; identical to SEQ ID NO: 152593
  derived and/or modified sequence opt4 from hemagglutinin__InfluenzaA__AFD64088

SEQ ID NO: 160825 - RNA, 1701 nt, Artificial Sequence; identical to SEQ ID NO: 152593
  derived and/or modified sequence opt4 from hemagglutinin__InfluenzaA__AFD64099

SEQ ID NO: 160826 - RNA, 1701 nt, Artificial Sequence; identical to SEQ ID NO: 160797
  derived and/or modified sequence opt4 from hemagglutinin__InfluenzaA__AFD64110

SEQ ID NO: 160827 - RNA, 1701 nt, Artificial Sequence
  derived and/or modified sequence opt4 from hemagglutinin__InfluenzaA__AFD64121
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcagagccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaaagagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160828 - RNA, 1701 nt, Artificial Sequence; identical to SEQ ID NO: 152593
  derived and/or modified sequence opt4 from hemagglutinin__InfluenzaA__AFD64132

SEQ ID NO: 160829 - RNA, 1701 nt, Artificial Sequence; identical to SEQ ID NO: 160787
  derived and/or modified sequence opt4 from hemagglutinin__InfluenzaA__AFD64143

SEQ ID NO: 160830 - RNA, 1701 nt, Artificial Sequence; identical to SEQ ID NO: 152593
  derived and/or modified sequence opt4 from hemagglutinin__InfluenzaA__AFD64154

SEQ ID NO: 160831 - RNA, 1701 nt, Artificial Sequence
  derived and/or modified sequence opt4 from hemagglutinin__InfluenzaA__AFD64179
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaucagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagccagaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160832 - RNA, 1701 nt, Artificial Sequence; identical to SEQ ID NO: 160831
  derived and/or modified sequence opt4 from hemagglutinin__InfluenzaA__AFD64190

SEQ ID NO: 160833 - RNA, 1701 nt, Artificial Sequence; identical to SEQ ID NO: 160787
  derived and/or modified sequence opt4 from hemagglutinin__InfluenzaA__AFD64201

SEQ ID NO: 160834 - RNA, 1701 nt, Artificial Sequence; identical to SEQ ID NO: 160797
  derived and/or modified sequence opt4 from hemagglutinin__InfluenzaA__AFD64212

SEQ ID NO: 160835 - RNA, 1701 nt, Artificial Sequence
  derived and/or modified sequence opt4 from hemagglutinin__InfluenzaA__AFD64223
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcugcaccccggcaccgacagcgaccagaucagacuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacaucaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccaguacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160836 - RNA, 1701 nt, Artificial Sequence
  derived and/or modified sequence opt4 from hemagglutinin__InfluenzaA__AFD64315
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaucagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaaccagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160837 - RNA, 1701 nt, Artificial Sequence; identical to SEQ ID NO: 160827
  derived and/or modified sequence opt4 from hemagglutinin__InfluenzaA__AFD64326

SEQ ID NO: 160838 - RNA, 1701 nt, Artificial Sequence; identical to SEQ ID NO: 160797
  derived and/or modified sequence opt4 from hemagglutinin__InfluenzaA__AFD64337

SEQ ID NO: 160839 - RNA, 1701 nt, Artificial Sequence; identical to SEQ ID NO: 152593
  derived and/or modified sequence opt4 from hemagglutinin__InfluenzaA__AFD64348

SEQ ID NO: 160840 - RNA, 1701 nt, Artificial Sequence; identical to SEQ ID NO: 160797
  derived and/or modified sequence opt4 from hemagglutinin__InfluenzaA__AFD64359

SEQ ID NO: 160841 - RNA, 1701 nt, Artificial Sequence
  derived and/or modified sequence opt4 from hemagglutinin__InfluenzaA__AFD64370
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccacugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaaagagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacaucagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160842 - RNA, 1701 nt, Artificial Sequence; identical to SEQ ID NO: 152593
  derived and/or modified sequence opt4 from hemagglutinin__InfluenzaA__AFD64381

SEQ ID NO: 160843 - RNA, 1701 nt, Artificial Sequence; identical to SEQ ID NO: 160797
  derived and/or modified sequence opt4 from hemagglutinin__InfluenzaA__AFD64392

SEQ ID NO: 160844 - RNA, 1701 nt, Artificial Sequence; identical to SEQ ID NO: 160787
  derived and/or modified sequence opt4 from hemagglutinin__InfluenzaA__AFD64403

SEQ ID NO: 160845 - RNA, 1701 nt, Artificial Sequence; identical to SEQ ID NO: 160787
  derived and/or modified sequence opt4 from hemagglutinin__InfluenzaA__AFD64414

SEQ ID NO: 160846 - RNA, 1701 nt, Artificial Sequence
  derived and/or modified sequence opt4 from hemagglutinin__InfluenzaA__AFD64425
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaucagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccaacuacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160847 - RNA, 1701 nt, Artificial Sequence; identical to SEQ ID NO: 152593
  derived and/or modified sequence opt4 from hemagglutinin__InfluenzaA__AFD64436

SEQ ID NO: 160848 - RNA, 1701 nt, Artificial Sequence; identical to SEQ ID NO: 152593
  derived and/or modified sequence opt4 from hemagglutinin__InfluenzaA__AFD64447

SEQ ID NO: 160849 - RNA, 1701 nt, Artificial Sequence
  derived and/or modified sequence opt4 from hemagglutinin__InfluenzaA__AFD64458
augaagaccaucaucgcccugagcuacauccugugccugguguucgcccagaagcugcccggcaacgacaacagcaccgccacccugugccugggccaccacgccgugcagaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160850 - RNA, 1701 nt, Artificial Sequence; identical to SEQ ID NO: 159375
  derived and/or modified sequence opt4 from hemagglutinin__InfluenzaA__AFD64795

SEQ ID NO: 160851 - RNA, 1701 nt, Artificial Sequence; identical to SEQ ID NO: 159502
  derived and/or modified sequence opt4 from hemagglutinin__InfluenzaA__AFD64799

SEQ ID NO: 160852 - RNA, 1701 nt, Artificial Sequence
  derived and/or modified sequence opt4 from hemagglutinin__InfluenzaA__AFD64802
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaccuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcgaguacaaggacuggauccuguggaucagcuucgccaucagcugcuuccugcugugcguggcccugcugggcuucaucaugugggccugccagaagggcaacaucagaugcaacaucugcaucuga

SEQ ID NO: 160853 - RNA, 1701 nt, Artificial Sequence
  derived and/or modified sequence opt4 from hemagglutinin__InfluenzaA__AFD64804
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160854 - RNA, 1701 nt, Artificial Sequence
  derived and/or modified sequence opt4 from hemagglutinin__InfluenzaA__AFD64806
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaccuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160855 - RNA, 1701 nt, Artificial Sequence
  derived and/or modified sequence opt4 from hemagglutinin__InfluenzaA__AFD64807
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaccuuccuguacgcccaggccagcggcagaaucaccgugagcaccaagagaagccagcaggccgugauccccaacaucggcagcagacccagagugagagacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgccccccugggcaagugccacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacauguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160856 - RNA, 1701 nt, Artificial Sequence
  derived and/or modified sequence opt4 from hemagglutinin__InfluenzaA__AFD64810
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccccgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160857 - RNA, 1701 nt, Artificial Sequence
  derived and/or modified sequence opt4 from hemagglutinin__InfluenzaA__AFD64812
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaccuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaccgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160858 - RNA, 1701 nt, Artificial Sequence
  derived and/or modified sequence opt4 from hemagglutinin__InfluenzaA__AFD64814
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaccuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccccgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160859 - RNA, 1701 nt, Artificial Sequence
  derived and/or modified sequence opt4 from hemagglutinin__InfluenzaA__AFD64816
augaagaccaucaucgcccugagcuacauccugugccugguguucgcccagaagcugcccgagaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaugagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160860 - RNA, 1701 nt, Artificial Sequence
  derived and/or modified sequence opt4 from hemagglutinin__InfluenzaA__AFD64818
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaccuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgccccccugggcaagugcaucagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160861 - RNA, 1701 nt, Artificial Sequence
  derived and/or modified sequence opt4 from hemagglutinin__InfluenzaA__AFD64819
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaccuuccuguacgcccaggccagcggcagaaucaccgugagcaccaagagaagccagcaggccgugauccccaacaucggcagcagacccagaaucagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaucagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccccgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160862 - RNA, 1701 nt, Artificial Sequence; identical to SEQ ID NO: 159502
  derived and/or modified sequence opt4 from hemagglutinin__InfluenzaA__AFD64820

SEQ ID NO: 160863 - RNA, 1701 nt, Artificial Sequence
  derived and/or modified sequence opt4 from hemagglutinin__InfluenzaA__AFD64822
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaugagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160864 - RNA, 1701 nt, Artificial Sequence
  derived and/or modified sequence opt4 from hemagglutinin__InfluenzaA__AFD64823
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccgccggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcagaugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160865 - RNA, 1701 nt, Artificial Sequence
  derived and/or modified sequence opt4 from hemagglutinin__InfluenzaA__AFD64824
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaccuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaccagcugcuuccugcugugcguggcccugcugggcuucaucaugugggccugccagaagggcaacaucagaugcaacaucugcaucuga

SEQ ID NO: 160866 - RNA, 1701 nt, Artificial Sequence; identical to SEQ ID NO: 160854
  derived and/or modified sequence opt4 from hemagglutinin__InfluenzaA__AFD64825

SEQ ID NO: 160867 - RNA, 1701 nt, Artificial Sequence; identical to SEQ ID NO: 160854
  derived and/or modified sequence opt4 from hemagglutinin__InfluenzaA__AFD64827

SEQ ID NO: 160868 - RNA, 1701 nt, Artificial Sequence
  derived and/or modified sequence opt4 from hemagglutinin__InfluenzaA__AFD64828
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccccgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160869 - RNA, 1701 nt, Artificial Sequence; identical to SEQ ID NO: 160863
  derived and/or modified sequence opt4 from hemagglutinin__InfluenzaA__AFD64830

SEQ ID NO: 160870 - RNA, 1701 nt, Artificial Sequence; identical to SEQ ID NO: 159502
  derived and/or modified sequence opt4 from hemagglutinin__InfluenzaA__AFD98095

SEQ ID NO: 160871 - RNA, 1701 nt, Artificial Sequence
  derived and/or modified sequence opt4 from hemagglutinin__InfluenzaA__AFD98106
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcgccggcgagaucugcgacagcccccaccacauccuggacggcgagaacugcacccugaucgacgcccugcugggcgacccccagugcgacggcuuccagaacaagaagugggaccuguucguggagagaagcagagccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160872 - RNA, 1701 nt, Artificial Sequence
  derived and/or modified sequence opt4 from hemagglutinin__InfluenzaA__AFD98128
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaaagagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccgccggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160873 - RNA, 1701 nt, Artificial Sequence; identical to SEQ ID NO: 159502
  derived and/or modified sequence opt4 from hemagglutinin__InfluenzaA__AFD98139

SEQ ID NO: 160874 - RNA, 1701 nt, Artificial Sequence
  derived and/or modified sequence opt4 from hemagglutinin__InfluenzaA__AFD98161
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcgccggcgagaucugcgacagcccccaccacauccuggacggcgagaacugcacccugaucgacgcccugcugggcgacccccagugcgacggcuuccagaacaagaagugggaccuguucguggagagaagcagagccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160875 - RNA, 1701 nt, Artificial Sequence
  derived and/or modified sequence opt4 from hemagglutinin__InfluenzaA__AFD98172
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcgccggcgagaucugcgacagcccccaccacauccuggacggcgagaacugcacccugaucgacgcccugcugggcgacccccagugcgacggcuuccagaacaagaagugggaccuguucguggagagaagcagagccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacugggugcuguggaucagcuucgccaucagcugcuuccugcugugcguggcccugcugggcuucaucaugugggccugccagaagggcaacaucagaugcaacaucugcaucuga

SEQ ID NO: 160876 - RNA, 1701 nt, Artificial Sequence
  derived and/or modified sequence opt4 from hemagglutinin__InfluenzaA__AFD98183
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugcugcccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcaccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160877 - RNA, 1701 nt, Artificial Sequence; identical to SEQ ID NO: 159375
  derived and/or modified sequence opt4 from hemagglutinin__InfluenzaA__AFD98194

SEQ ID NO: 160878 - RNA, 1701 nt, Artificial Sequence; identical to SEQ ID NO: 159429
  derived and/or modified sequence opt4 from hemagglutinin__InfluenzaA__AFD98205

SEQ ID NO: 160879 - RNA, 1701 nt, Artificial Sequence; identical to SEQ ID NO: 160871
  derived and/or modified sequence opt4 from hemagglutinin__InfluenzaA__AFD98215

SEQ ID NO: 160880 - RNA, 1701 nt, Artificial Sequence; identical to SEQ ID NO: 159502
  derived and/or modified sequence opt4 from hemagglutinin__InfluenzaA__AFD98226

SEQ ID NO: 160881 - RNA, 1701 nt, Artificial Sequence
  derived and/or modified sequence opt4 from hemagglutinin__InfluenzaA__AFD98237
augaagaccaucaucgcccugagcuacauccugugccuggugagcgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160882 - RNA, 1701 nt, Artificial Sequence; identical to SEQ ID NO: 160874
  derived and/or modified sequence opt4 from hemagglutinin__InfluenzaA__AFD98248

SEQ ID NO: 160883 - RNA, 1701 nt, Artificial Sequence
  derived and/or modified sequence opt4 from hemagglutinin__InfluenzaA__AFD98259
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcgccggcgagaucugcgacagcccccaccacauccuggacggcgagaacugcacccugaucgacgcccugcugggcgacccccagugcgacggcuuccagaacaagaagugggaccuguucguggagagaagcaaggccuacagcaacugcuaccccuacgacgugcaggacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160884 - RNA, 1701 nt, Artificial Sequence
  derived and/or modified sequence opt4 from hemagglutinin__InfluenzaA__AFD98270
augaaggccauccugguggugcugcuguacaccuucgugaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcgugaccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaacaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160885 - RNA, 1701 nt, Artificial Sequence
  derived and/or modified sequence opt4 from hemagglutinin__InfluenzaA__AFD98280
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgacagccugagcaccgccagaagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160886 - RNA, 1701 nt, Artificial Sequence; identical to SEQ ID NO: 160863
  derived and/or modified sequence opt4 from hemagglutinin__InfluenzaA__AFD98290

SEQ ID NO: 160887 - RNA, 1701 nt, Artificial Sequence; identical to SEQ ID NO: 159606
  derived and/or modified sequence opt4 from hemagglutinin__InfluenzaA__AFD98310

SEQ ID NO: 160888 - RNA, 1701 nt, Artificial Sequence; identical to SEQ ID NO: 158974
  derived and/or modified sequence opt4 from hemagglutinin__InfluenzaA__AFD98320

SEQ ID NO: 160889 - RNA, 1701 nt, Artificial Sequence; identical to SEQ ID NO: 160874
  derived and/or modified sequence opt4 from hemagglutinin__InfluenzaA__AFD98340

SEQ ID NO: 160890 - RNA, 1701 nt, Artificial Sequence
  derived and/or modified sequence opt4 from hemagglutinin__InfluenzaA__AFD98351
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcgccggcgagaucugcgacagcccccaccacauccuggacggcgagaacugcacccugaucgacgcccugcugggcgacccccagugcgacggcuuccagaacaagaagugggaccuguucguggagagaagcagagccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcaccaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160891 - RNA, 1701 nt, Artificial Sequence
  derived and/or modified sequence opt4 from hemagglutinin__InfluenzaA__AFD98362
augaagaccaucaucgcccugagcuacauccugugccugguguucgcccagaagcugcccggcaacgacaacagcauggccacccugugccugggccaccacgccgugcccaacggcaccaucgugaagaccaucaccaacgaccagaucgaggugaccaacgccaccgagcuggugcagaacagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaggccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacuggugggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160892 - RNA, 1701 nt, Artificial Sequence; identical to SEQ ID NO: 160871
  derived and/or modified sequence opt4 from hemagglutinin__InfluenzaA__AFD98373

SEQ ID NO: 160893 - RNA, 1701 nt, Artificial Sequence; identical to SEQ ID NO: 159502
  derived and/or modified sequence opt4 from hemagglutinin__InfluenzaA__AFD98384

SEQ ID NO: 160894 - RNA, 1701 nt, Artificial Sequence
  derived and/or modified sequence opt4 from hemagglutinin__InfluenzaA__AFD98395
augaagaccaucaucgcccugagcuacauccugugccugguguucgcccagaagcugcccggcgacgacaacagcaccgccacccugugccugggccaccacgccgugcccaacggcaccaucgugaagaccaucaccaacgaccagaucgaggugaccaacgccaccgagcuggugcagaacagcagcgccggcgagaucugcgacagcccccaccacauccuggacggcgagaacugcacccugaucgacgcccugcugggcgacccccagugcgacggcuuccagaacaagaagugggaccuguucguggagagaagcagagccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160895 - RNA, 1701 nt, Artificial Sequence; identical to SEQ ID NO: 160871
  derived and/or modified sequence opt4 from hemagglutinin__InfluenzaA__AFD98406

SEQ ID NO: 160896 - RNA, 1701 nt, Artificial Sequence; identical to SEQ ID NO: 160874
  derived and/or modified sequence opt4 from hemagglutinin__InfluenzaA__AFD98417

SEQ ID NO: 160897 - RNA, 1701 nt, Artificial Sequence
  derived and/or modified sequence opt4 from hemagglutinin__InfluenzaA__AFD98428
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaccuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucaccaucagcugcuuccugcugugcguggcccugcugggcuucaucaugugggccugccagaagggcaacaucagaugcaacaucugcaucuga

SEQ ID NO: 160898 - RNA, 1701 nt, Artificial Sequence; identical to SEQ ID NO: 159387
  derived and/or modified sequence opt4 from hemagglutinin__InfluenzaA__AFD98439

SEQ ID NO: 160899 - RNA, 1701 nt, Artificial Sequence
  derived and/or modified sequence opt4 from hemagglutinin__InfluenzaA__AFD98449
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagaacuucaacuggaccggcgugacccagaacggcaccagcagcgccugcaucagaagaagcaagaacagcuucuucagcagacugaacuggcugacccaccugaacuucaaguuccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgccauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160900 - RNA, 1701 nt, Artificial Sequence
  derived and/or modified sequence opt4 from hemagglutinin__InfluenzaA__AFD98460
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcgccggcgagaucugcgacagcccccaccacauccuggacggcgagaacugcacccugaucgacgcccugcugggcgacccccagugcgacggcuuccagaacaagaagugggaccuguucguggagagaagcagagccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcaagcugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugagcaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160901 - RNA, 1701 nt, Artificial Sequence; identical to SEQ ID NO: 159387
  derived and/or modified sequence opt4 from hemagglutinin__InfluenzaA__AFD98471

SEQ ID NO: 160902 - RNA, 1701 nt, Artificial Sequence
  derived and/or modified sequence opt4 from hemagglutinin__InfluenzaA__AFD98481
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccgccggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcgugaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160903 - RNA, 1701 nt, Artificial Sequence; identical to SEQ ID NO: 159502
  derived and/or modified sequence opt4 from hemagglutinin__InfluenzaA__AFD98492

SEQ ID NO: 160904 - RNA, 1701 nt, Artificial Sequence
  derived and/or modified sequence opt4 from hemagglutinin__InfluenzaA__AFD98503
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcgccggcgagaucugcgacagcccccaccacauccuggacggcgagaacugcacccugaucgacgcccugcugggcgacccccagugcgacggcuuccagaacaagaagugggaccuguucguggagagaagcagagccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccaagggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160905 - RNA, 1701 nt, Artificial Sequence; identical to SEQ ID NO: 159502
  derived and/or modified sequence opt4 from hemagglutinin__InfluenzaA__AFD98514

SEQ ID NO: 160906 - RNA, 1701 nt, Artificial Sequence; identical to SEQ ID NO: 160854
  derived and/or modified sequence opt4 from hemagglutinin__InfluenzaA__AFD98525

SEQ ID NO: 160907 - RNA, 1701 nt, Artificial Sequence; identical to SEQ ID NO: 159375
  derived and/or modified sequence opt4 from hemagglutinin__InfluenzaA__AFD98558

SEQ ID NO: 160908 - RNA, 1701 nt, Artificial Sequence
  derived and/or modified sequence opt4 from hemagglutinin__InfluenzaA__AFD98569
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaccuuccuguacgcccaggccagcggcagaaucaccgugagcaccaagagaagccagcaggccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacgagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 160909 - RNA, 1701 nt, Artificial Sequence; identical to SEQ ID NO: 159375
  derived and/or modified sequence opt4 from hemagglutinin__InfluenzaA__AFD98580

SEQ ID NO: 160910 - RNA, 1701 nt, Artificial Sequence
  derived and/or modified sequence opt4 from hemagglutinin__InfluenzaA__AFE02942
augaaggccauccugguggugcugcuguacaccuucgccaccgccaacgccgacacccugugcaucggcuaccacgccaacaacagcaccgacaccguggacacccugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcaacagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucguguggaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggacagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160911 - RNA, 1701 nt, Artificial Sequence; identical to SEQ ID NO: 156353
  derived and/or modified sequence opt4 from hemagglutinin__InfluenzaA__AFE18688

SEQ ID NO: 160912 - RNA, 1701 nt, Artificial Sequence; identical to SEQ ID NO: 153170
  derived and/or modified sequence opt4 from hemagglutinin__InfluenzaA__AFE47624

SEQ ID NO: 160913 - RNA, 1701 nt, Artificial Sequence; identical to SEQ ID NO: 153920
  derived and/or modified sequence opt4 from hemagglutinin__InfluenzaA__AFE47635

SEQ ID NO: 160914 - RNA, 1701 nt, Artificial Sequence; identical to SEQ ID NO: 159502
  derived and/or modified sequence opt4 from hemagglutinin__InfluenzaA__AFF18506

SEQ ID NO: 160915 - RNA, 1701 nt, Artificial Sequence
  derived and/or modified sequence opt4 from hemagglutinin__InfluenzaA__AFF57124
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaaggagaacagcuaccccaagcugagcaagagcuacaucaacgacaagggcaaggaggugcuggugcuguggggcauccaccaccccagcaccaccgccgaccagcagagacuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160916 - RNA, 1701 nt, Artificial Sequence
  derived and/or modified sequence opt4 from hemagglutinin__InfluenzaA__AFF57128
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagcaucuaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160917 - RNA, 1701 nt, Artificial Sequence
  derived and/or modified sequence opt4 from hemagglutinin__InfluenzaA__AFF57132
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccaccgccgaccagcagagcaucuaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacgagaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160918 - RNA, 1701 nt, Artificial Sequence
  derived and/or modified sequence opt4 from hemagglutinin__InfluenzaA__AFF57136
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagacagagagggcagaaugaacuacuacuggacccugguggagcccggcgacaagaucaccuucgaggccaccggcaaccugguggugcccagauacgccuucgccauggagagaaacgccggcagcggcaucaucaucagcgacacccccguguacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160919 - RNA, 1701 nt, Artificial Sequence
  derived and/or modified sequence opt4 from hemagglutinin__InfluenzaA__AFF57144
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgacgaccagcagagccuguaccagaacgaggacgccuacguguucgugggcagcagcagauacagcaagaaguucaagcccgagaucgccaucagacccaaggugagagacagagagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160920 - RNA, 1701 nt, Artificial Sequence
  derived and/or modified sequence opt4 from hemagglutinin__InfluenzaA__AFF57148
augaaggccauccugguggugcugcuguacaccuucgccaccgccaacgccgacacccugugcaucggcuaccacgccaacaacagcaccgacaccguggacacccugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgacgaccagcagagccuguaccagaacgaggacgccuacguguucgugggcagcagcagauacagcaagaaguucaagcccgagaucgccaucagacccaaggugagagacagagagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160921 - RNA, 1701 nt, Artificial Sequence
  derived and/or modified sequence opt4 from hemagglutinin__InfluenzaA__AFF57160
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcgagagcuacaucaacgacaagggcaaggaggugcuggugcuguggggcauccaccaccccagcaccagcgccgaccagcagagccuguaccagaacgaggacgccuacguguucgugggcagcagcagauacagcaagaaguucaagcccgagaucgccaucagacccaaggugagagacagagagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160922 - RNA, 1701 nt, Artificial Sequence
  derived and/or modified sequence opt4 from hemagglutinin__InfluenzaA__AFF57164
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacgagaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagacagagagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160923 - RNA, 1701 nt, Artificial Sequence; identical to SEQ ID NO: 160922
  derived and/or modified sequence opt4 from hemagglutinin__InfluenzaA__AFF57168

SEQ ID NO: 160924 - RNA, 1701 nt, Artificial Sequence
  derived and/or modified sequence opt4 from hemagglutinin__InfluenzaA__AFF57172
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgaggacgccuacguguucgugggcagcagcagauacagcaagaaguucaagcccgagaucgccaucagacccaaggugagagacagagagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160925 - RNA, 1701 nt, Artificial Sequence
  derived and/or modified sequence opt4 from hemagglutinin__InfluenzaA__AFF57176
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaaggagaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagacagagagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160926 - RNA, 1701 nt, Artificial Sequence
  derived and/or modified sequence opt4 from hemagglutinin__InfluenzaA__AFF57184
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaaggagaacagcuaccagaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagacagagagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160927 - RNA, 1701 nt, Artificial Sequence; identical to SEQ ID NO: 160919
  derived and/or modified sequence opt4 from hemagglutinin__InfluenzaA__AFF57188

SEQ ID NO: 160928 - RNA, 1707 nt, Artificial Sequence
  derived and/or modified sequence opt4 from hemagglutinin__InfluenzaA__AFF60787
auggagaagaucgugcugcuguucgccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgugaacgaccugugcuaccccggcgacuucaacgacuacgaggagcugaagcaccugcugagcagaaucaaccacuucgagaagauccagaucauccccaagagcagcuggagcagccacgaggccagccugggcgugagcagcgccugccccuaccagggcaagagcagcuucuucagaaacgugguguggcugaucaagaagaacagcaccuaccccaccaucaagagaagcuacaacaacaccaaccaggaggaccugcuggugcuguggggcauccaccaccccaacgacgccgccgagcagaccaagcuguaccagaaccccaccaccuacaucagcgugggcaccagcacccugaaccagagacuggugcccagaaucgccaccagaagcgaggugaacggccagagcggcagaauggaguucuucuggaccauccugaagcccaacgacgccaucaacuucgagagcaacggcaacuucaucgcccccgaguacgccuacaagaucgugaagaagggcgacagcaccaucaugaagagcgagcuggaguacggcaacugcaacaccaagugccagacccccaugggcgccaucaacagcagcaugcccuuccacaacauccacccccugaccaucggcgagugccccaaguacgugaagagcaacagacuggugcuggccaccggccugagaaacagcccccagagagagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaucuaccagauccugagcaucuacagcaccguggccagcagccuggcccuggccaucaugguggccggccugagccuguggaugugcagcaacggcagccugcagugcagaaucugcaucuga

SEQ ID NO: 160929 - RNA, 1701 nt, Artificial Sequence
  derived and/or modified sequence opt4 from hemagglutinin__InfluenzaA__AFG29042
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccuucagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugaucgagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160930 - RNA, 1701 nt, Artificial Sequence
  derived and/or modified sequence opt4 from hemagglutinin__InfluenzaA__AFG29044
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagacccccaacagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccacccccccaccagcaccgaccagcagagccuguaccagaacgccgacgccuacguguucgugggcaccagcagauacagcaagaaguucaagcccgagaucgccaucagacccaaggugagaggccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160931 - RNA, 1701 nt, Artificial Sequence; identical to SEQ ID NO: 155189
  derived and/or modified sequence opt4 from hemagglutinin__InfluenzaA__AFG31060

SEQ ID NO: 160932 - RNA, 1701 nt, Artificial Sequence; identical to SEQ ID NO: 157744
  derived and/or modified sequence opt4 from hemagglutinin__InfluenzaA__AFG31070

SEQ ID NO: 160933 - RNA, 1701 nt, Artificial Sequence; identical to SEQ ID NO: 155176
  derived and/or modified sequence opt4 from hemagglutinin__InfluenzaA__AFG31080

SEQ ID NO: 160934 - RNA, 1701 nt, Artificial Sequence
  derived and/or modified sequence opt4 from hemagglutinin__InfluenzaA__AFG31100
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgaccugaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugaucgugagccugggcgccaucagcuucuggaugugcagcaacggcagccugcagugcagaaucugcaucuga

SEQ ID NO: 160935 - RNA, 1701 nt, Artificial Sequence; identical to SEQ ID NO: 155189
  derived and/or modified sequence opt4 from hemagglutinin__InfluenzaA__AFG31110

SEQ ID NO: 160936 - RNA, 1701 nt, Artificial Sequence; identical to SEQ ID NO: 155431
  derived and/or modified sequence opt4 from hemagglutinin__InfluenzaA__AFG31120

SEQ ID NO: 160937 - RNA, 1701 nt, Artificial Sequence; identical to SEQ ID NO: 155431
  derived and/or modified sequence opt4 from hemagglutinin__InfluenzaA__AFG31130

SEQ ID NO: 160938 - RNA, 1701 nt, Artificial Sequence; identical to SEQ ID NO: 155431
  derived and/or modified sequence opt4 from hemagglutinin__InfluenzaA__AFG31140

SEQ ID NO: 160939 - RNA, 1701 nt, Artificial Sequence; identical to SEQ ID NO: 156291
  derived and/or modified sequence opt4 from hemagglutinin__InfluenzaA__AFG31150

SEQ ID NO: 160940 - RNA, 1701 nt, Artificial Sequence; identical to SEQ ID NO: 156291
  derived and/or modified sequence opt4 from hemagglutinin__InfluenzaA__AFG31160

SEQ ID NO: 160941 - RNA, 1701 nt, Artificial Sequence; identical to SEQ ID NO: 155189
  derived and/or modified sequence opt4 from hemagglutinin__InfluenzaA__AFG31170

SEQ ID NO: 160942 - RNA, 1701 nt, Artificial Sequence; identical to SEQ ID NO: 155189
  derived and/or modified sequence opt4 from hemagglutinin__InfluenzaA__AFG31180

SEQ ID NO: 160943 - RNA, 1701 nt, Artificial Sequence; identical to SEQ ID NO: 155189
  derived and/or modified sequence opt4 from hemagglutinin__InfluenzaA__AFG31190

SEQ ID NO: 160944 - RNA, 1701 nt, Artificial Sequence; identical to SEQ ID NO: 155189
  derived and/or modified sequence opt4 from hemagglutinin__InfluenzaA__AFG31200

SEQ ID NO: 160945 - RNA, 1701 nt, Artificial Sequence; identical to SEQ ID NO: 155189
  derived and/or modified sequence opt4 from hemagglutinin__InfluenzaA__AFG31210

SEQ ID NO: 160946 - RNA, 1701 nt, Artificial Sequence; identical to SEQ ID NO: 155189
  derived and/or modified sequence opt4 from hemagglutinin__InfluenzaA__AFG31220

SEQ ID NO: 160947 - RNA, 1701 nt, Artificial Sequence; identical to SEQ ID NO: 157744
  derived and/or modified sequence opt4 from hemagglutinin__InfluenzaA__AFG31230

SEQ ID NO: 160948 - RNA, 1701 nt, Artificial Sequence; identical to SEQ ID NO: 155189
  derived and/or modified sequence opt4 from hemagglutinin__InfluenzaA__AFG31240

SEQ ID NO: 160949 - RNA, 1701 nt, Artificial Sequence; identical to SEQ ID NO: 155189
  derived and/or modified sequence opt4 from hemagglutinin__InfluenzaA__AFG31250

SEQ ID NO: 160950 - RNA, 1701 nt, Artificial Sequence; identical to SEQ ID NO: 155189
  derived and/or modified sequence opt4 from hemagglutinin__InfluenzaA__AFG31260

SEQ ID NO: 160951 - RNA, 1701 nt, Artificial Sequence; identical to SEQ ID NO: 155189
  derived and/or modified sequence opt4 from hemagglutinin__InfluenzaA__AFG31270

SEQ ID NO: 160952 - RNA, 1701 nt, Artificial Sequence; identical to SEQ ID NO: 155189
  derived and/or modified sequence opt4 from hemagglutinin__InfluenzaA__AFG31280

SEQ ID NO: 160953 - RNA, 1701 nt, Artificial Sequence; identical to SEQ ID NO: 155189
  derived and/or modified sequence opt4 from hemagglutinin__InfluenzaA__AFG31290

SEQ ID NO: 160954 - RNA, 1701 nt, Artificial Sequence
  derived and/or modified sequence opt4 from hemagglutinin__InfluenzaA__AFG31300
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacaucaaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 160955 - RNA, 1701 nt, Artificial Sequence; identical to SEQ ID NO: 157744
  derived and/or modified sequence opt4 from hemagglutinin__InfluenzaA__AFG31310

SEQ ID NO: 160956 - RNA, 1701 nt, Artificial Sequence; identical to SEQ ID NO: 155189
  derived and/or modified sequence opt4 from hemagglutinin__InfluenzaA__AFG31323

SEQ ID NO: 160957 - RNA, 1701 nt, Artificial Sequence; identical to SEQ ID NO: 155189
  derived and/or modified sequence opt4 from hemagglutinin__InfluenzaA__AFG31333

SEQ ID NO: 160958 - RNA, 1701 nt, Artificial Sequence; identical to SEQ ID NO: 155189
  derived and/or modified sequence opt4 from hemagglutinin__InfluenzaA__AFG31343

SEQ ID NO: 160959 - RNA, 1701 nt, Artificial Sequence; identical to SEQ ID NO: 155189
  derived and/or modified sequence opt4 from hemagglutinin__InfluenzaA__AFG31353

SEQ ID NO: 160960 - RNA, 1701 nt, Artificial Sequence; identical to SEQ ID NO: 155189
  derived and/or modified sequence opt4 from hemagglutinin__InfluenzaA__AFG31363

SEQ ID NO: 160961 - RNA, 1701 nt, Artificial Sequence; identical to SEQ ID NO: 155189
  derived and/or modified sequence opt4 from hemagglutinin__InfluenzaA__AFG31376

SEQ ID NO: 160962 - RNA, 1701 nt, Artificial Sequence; identical to SEQ ID NO: 155189
  derived and/or modified sequence opt4 from hemagglutinin__InfluenzaA__AFG31386

SEQ ID NO: 160963 - RNA, 1701 nt, Artificial Sequence; identical to SEQ ID NO: 155189
  derived and/or modified sequence opt4 from hemagglutinin__InfluenzaA__AFG31396

SEQ ID NO: 160964 - RNA, 1701 nt, Artificial Sequence; identical to SEQ ID NO: 155189
  derived and/or modified sequence opt4 from hemagglutinin__InfluenzaA__AFG31406

SEQ ID NO: 160965 - RNA, 1701 nt, Artificial Sequence; identical to SEQ ID NO: 155189
  derived and/or modified sequence opt4 from hemagglutinin__InfluenzaA__AFG31416

SEQ ID NO: 160966 - RNA, 1701 nt, Artificial Sequence; identical to SEQ ID NO: 155189
  derived and/or modified sequence opt4 from hemagglutinin__InfluenzaA__AFG31426

SEQ ID NO: 160967 - RNA, 1701 nt, Artificial Sequence; identical to SEQ ID NO: 155189
  derived and/or modified sequence opt4 from hemagglutinin__InfluenzaA__AFG31436

SEQ ID NO: 160968 - RNA, 1701 nt, Artificial Sequence; identical to SEQ ID NO: 155189
  derived and/or modified sequence opt4 from hemagglutinin__InfluenzaA__AFG31446

SEQ ID NO: 160969 - RNA, 1701 nt, Artificial Sequence; identical to SEQ ID NO: 155189
  derived and/or modified sequence opt4 from hemagglutinin__InfluenzaA__AFG31456

SEQ ID NO: 160970 - RNA, 1701 nt, Artificial Sequence; identical to SEQ ID NO: 155189
  derived and/or modified sequence opt4 from hemagglutinin__InfluenzaA__AFG31466

SEQ ID NO: 160971 - RNA, 1701 nt, Artificial Sequence; identical to SEQ ID NO: 156291
  derived and/or modified sequence opt4 from hemagglutinin__InfluenzaA__AFG31486

SEQ ID NO: 160972 - RNA, 1701 nt, Artificial Sequence; identical to SEQ ID NO: 155189
  derived and/or modified sequence opt4 from hemagglutinin__InfluenzaA__AFG31496

SEQ ID NO: 160973 - RNA, 1701 nt, Artificial Sequence; identical to SEQ ID NO: 155189
  derived and/or modified sequence opt4 from hemagglutinin__InfluenzaA__AFG31506

SEQ ID NO: 160974 - RNA, 1701 nt, Artificial Sequence; identical to SEQ ID NO: 155189
  derived and/or modified sequence opt4 from hemagglutinin__InfluenzaA__AFG31516

SEQ ID NO: 160975 - RNA, 1701 nt, Artificial Sequence; identical to SEQ ID NO: 155280
  derived and/or modified sequence opt4 from hemagglutinin__InfluenzaA__AFG31526

SEQ ID NO: 160976 - RNA, 1701 nt, Artificial Sequence; identical to SEQ ID NO: 155189
  derived and/or modified sequence opt4 from hemagglutinin__InfluenzaA__AFG31536

SEQ ID NO: 160977 - RNA, 1701 nt, Artificial Sequence; identical to SEQ ID NO: 157744
  derived and/or modified sequence opt4 from hemagglutinin__InfluenzaA__AFG31546

SEQ ID NO: 160978 - RNA, 1701 nt, Artificial Sequence; identical to SEQ ID NO: 157744
  derived and/or modified sequence opt4 from hemagglutinin__InfluenzaA__AFG31556

SEQ ID NO: 160979 - RNA, 1701 nt, Artificial Sequence; identical to SEQ ID NO: 155189
  derived and/or modified sequence opt4 from hemagglutinin__InfluenzaA__AFG31566

SEQ ID NO: 160980 - RNA, 1701 nt, Artificial Sequence; identical to SEQ ID NO: 155431
  derived and/or modified sequence opt4 from hemagglutinin__InfluenzaA__AFG31586

SEQ ID NO: 160981 - RNA, 1701 nt, Artificial Sequence; identical to SEQ ID NO: 155431
  derived and/or modified sequence opt4 from hemagglutinin__InfluenzaA__AFG31596

SEQ ID NO: 160982 - RNA, 1701 nt, Artificial Sequence; identical to SEQ ID NO: 155431
  derived and/or modified sequence opt4 from hemagglutinin__InfluenzaA__AFG31606

SEQ ID NO: 160983 - RNA, 1701 nt, Artificial Sequence; identical to SEQ ID NO: 155431
  derived and/or modified sequence opt4 from hemagglutinin__InfluenzaA__AFG31616

SEQ ID NO: 160984 - RNA, 1701 nt, Artificial Sequence; identical to SEQ ID NO: 155431
  derived and/or modified sequence opt4 from hemagglutinin__InfluenzaA__AFG31626

SEQ ID NO: 160985 - RNA, 1701 nt, Artificial Sequence; identical to SEQ ID NO: 155189
  derived and/or modified sequence opt4 from hemagglutinin__InfluenzaA__AFG31636

SEQ ID NO: 160986 - RNA, 1701 nt, Artificial Sequence; identical to SEQ ID NO: 155189
  derived and/or modified sequence opt4 from hemagglutinin__InfluenzaA__AFG31646

SEQ ID NO: 160987 - RNA, 1701 nt, Artificial Sequence; identical to SEQ ID NO: 156353
  derived and/or modified sequence opt4 from hemagglutinin__InfluenzaA__AFG31656

SEQ ID NO: 160988 - RNA, 1701 nt, Artificial Sequence; identical to SEQ ID NO: 156353
  derived and/or modified sequence opt4 from hemagglutinin__InfluenzaA__AFG31666

SEQ ID NO: 160989 - RNA, 1701 nt, Artificial Sequence
  derived and/or modified sequence opt4 from hemagglutinin__InfluenzaA__AFG71865
augaagaccaucaucgcccugagcuacaucuucugccuggcccugggccaggaccugcccggcaacgacaacagcaccgccacccugugccugggccaccacgccgugcccaacggcacccuggugaagaccaucaccaacgaccagaucgaggugaccaacgccaccgagcuggugcagagcagcagcaccggcaagaucugcaacaacccccacagaauccuggacggcaucgacugcacccugaucgacgcccugcugggcgacccccacugcgacguguuccagaacgagaccugggaccuguucguggagagaagcaaggccuucagcaacugcuaccccuacgacgugcccgacuacgccagccugagaagccugguggccagcagcggcacccuggaguucaucaccgagggcuucaccuggaccggcgugacccagaacggcggcagcaacgccugcaagagaggccccggcaucggcuucuucagcagacugaacuggcugaccaagagcggcagcaccuaccccgugcugaacgugaccaugcccaacaacgacaacuucgacaagcuguacaucuggggcgugcaccaccccagcaccaaccaggagcagaccagccuguacgugcaggccagcggcagagugaccgugagcaccagaagaagccagcagaccaucauccccaacaucggcagcagacccugggugagaggccugagcagcagaaucagcaucuacuggaccaucgugaagcccggcgacgugcuggugaucaacagcaacggcaaccugaucgcccccagaggcuacuucaagaugagaaccggcaagagcagcaucaugagaagcgacgcccccaucgacaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggccuguucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucgagagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagagaggcaacaucagaugcaacaucugcaucuga

SEQ ID NO: 160990 - RNA, 1701 nt, Artificial Sequence; identical to SEQ ID NO: 154076
  derived and/or modified sequence opt4 from hemagglutinin__InfluenzaA__AFG71876

SEQ ID NO: 160991 - RNA, 1701 nt, Artificial Sequence
  derived and/or modified sequence opt4 from hemagglutinin__InfluenzaA__AFG71898
augaagaccaucaucgcccugagcuaccuguucugccuggccuucggccaggaccugcccggcaacgacaacagcaccgccacccugugccugggccaccacgccgugcccaacggcacccuggugaagaccaucaccgacgaccagaucgaggugaccaacgccaccgagcuggugcagagcagcagcaccggcaagaucugcaacaacccccacagaauccuggacggcaucgacugcacccugaucgacgcccugcugggcgacccccacugcgacguguuccagaacgagaccugggaccuguucguggagagaagcaaggccuucagcaacugcuaccccuacgacgugcccgacuacgccagccugagaagccugguggccagcagcggcacccuggaguucaccaccgagggcuucaccuggaccggcgugacccagaacggcggcagcaacgccugcaagagaggccccggcagcggcuucuucagcagacugaacuggcugaccaagagcggcagcaccuaccccgugcugaacgugaccaugagcaacaacgacaacuucgacaagcuguacaucuggggcgugcaccaccccagcaccaaccaggagcagaccagccuguacgugcaggccagcggcagagugaccgugagcaccagaagaagccagcagaccaucauccccaacaucggcagcagacccugggugagaggccugagcagcagaaucagcaucuacuggaccaucgugaagcccggcgacgugcuggugaucaacagcaacggcaaccugaucgcccccagaggcuacuucaagaugagaaccggcaagagcagcaucaugagaagcgacgcccccaucgacaccugcgugagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggccuguucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucgagagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagagaggcaacaucagaugcaacaucugcaucuga

SEQ ID NO: 160992 - RNA, 1701 nt, Artificial Sequence
  derived and/or modified sequence opt4 from hemagglutinin__InfluenzaA__AFG71920
augaagaccaucaucgcccugagcuacaucuucugccuggcccugggccaggaccugcccggcaacgacaacagcaccgccacccugugccugggccaccacgccgugcccaacggcacccuggugaagaccaucaccaacgaccagaucgaggugaccaacgccaccgagcuggugcagagcagcagcaccggcaagaucugcaacaacccccacagaauccuggacggcaucaacugcacccugaucgacgcccugcugggcgacccccacugcgacguguuccaggacgagaccugggaccuguucguggagagaagcaaggccuucagcaacugcuaccccuacgacgugcccgacuacgccagccugagaagccugaucgccagcagcggcacccuggaguucaucaccgagggcuucaccuggaccggcgugacccagaacggcggcagcaacgccugcaagagaggccccggcagcggcuucuucagcagacugaacuggcugaccaagagcggcagcaccuaccccgugcugaacgugaccaugcccaacaacgacaacuucgacaagcuguacaucuggggcgugcaccaccccagcaccaaccaggagcagaccagccuguacgugcaggccagcggcagagugaccgugagcaccagaagaagccagcagaccaucauccccaacaucggcagcagacccugggugagaggccugagcagcagaaucagcaucuacuggaccaucgugaagcccggcgacgugcuggugaucaacagcaacggcaaccugaucgcccccagaggcuacuucaagaugagaaccggcaagagcagcaucaugagaagcgacgcccccaucgacaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggccuguucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucgagagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagagaggcaacaucagaugcaacaucugcaucuga

SEQ ID NO: 160993 - RNA, 1701 nt, Artificial Sequence
  derived and/or modified sequence opt4 from hemagglutinin__InfluenzaA__AFG71931
augaagaccaucaucgcccugagcuacaucuucugccuggugaucggccaggaccugcccggcaacgagaacagcaccgccacccugugccugggccaccacgccgugcccaacggcacccuggugaagaccaucaccaacgaccagaucgaggugaccaacgccaccgagcuggugcagagcagcagcaccggcaagaucugcaacaacccccacagaauccuggacggcaucgacugcacccugaucgacgcccugcugggcgacccccacugcgacggcuuccagaacgagaccugggaccuguucguggagagaagcaaggccuucagcaacugcuaccccuacgacgugcccgacuacgccagccugagaagccugguggccagcagcggcacccuggaguucaucaccgagggcuucaccuggaccggcgugacccagaacggcggcagcaacgccugcaagagaggccccggcaucggcuucuucagcagacugaacuggcugaccaagagcggcagcaccuaccccgugcugaacgugaccaugcccaacaacgacaacuucgacaagcuguacaucuggggcgugcaccaccccagcaccaaccaggagcagaccagccuguacgugcaggccagcggcagagugaccgugagcaccagaagaagccagcagaccaucauccccaacaucggcagcagacccugggugagaggccugagcagcagaaucagcaucuacuggaccaucgugaagcccggcgacgugcuggugaucaacagcaacggcaaccugaucgcccccagaggcuacuucaagaugagaaccggcaagagcagcaucaugagaagcgacgcccccaucgacaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggccuguucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucgagagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagagaggcaacaucagaugcaacaucugcaucuga

SEQ ID NO: 160994 - RNA, 1701 nt, Artificial Sequence
  derived and/or modified sequence opt4 from hemagglutinin__InfluenzaA__AFG71942
augaagaccaucaucgcccugagcuacaucuucuaccuggcccugagccaggaccugcccggcaacgacaacagcaaggccacccugugccugggccaccacgccgugcccaacggcacccuggugaagaccaucaccgacgaccagaccgaggugaccaacgccaccgagcuggugcagagcagcagcaccggcaagaucugcaacaacccccacagaauccuggacggcauggacugcacccugaucgacgcccugcugggcgacccccacugcgacguguuccagaacgagaccugggaccuguucguggagagaagcaaggccuucagcaacugcuaccccuacgacgugcccgacuacgccagccugagaagccugguggccagcagcggcacccuggaguucaucaccgagggcuucaccuggaccgaggugacccagaacggcggcagcaucgccugcaagagaggccccgacagcggcuucuucagcagacugaacuggcugaccaagagcggcagaaccuaccccgugcugaacgugaccaugcccaacaacgacaacuucgacaagcuguacaucuggggcgugcaccaccccagcaccgaccaggagcagaccaaccuguacgugcagaccagcggcagagugaccgugagcaccagaagaagccagcagaccaucauccccaacaucggcagcagacccugggugagaggccugagcagcagaaucagcaucuacuggaccaucgugaagcccggcgacgugcuggugaucaacagcaacggcaaccugaucgcccccagaggcuacuucaagaugagaaccggcaagagcagcaucaugagaagcgacgcccccaucgacaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggccuguucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagaaucaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucgagagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagagaggcaacaucagaugcaacaucugcaucuga

SEQ ID NO: 160995 - RNA, 1701 nt, Artificial Sequence
  derived and/or modified sequence opt4 from hemagglutinin__InfluenzaA__AFG71953
augaagaccaucaucgcccugagcuacaucuucugccuggugcugggccaggaccugcccggcaacgacaagagcaccgccacccugugccugggccaccacgccgugcccaacggcacccuggugaagaccaucaccaacgaccagaucgaggugaccaacgccaccgagcuggugcagagcagcagcaccggcaagaucugcaacaacccccacagaauccuggacggcaucgacugcacccugaucgacgcccugcugggcgacccccacugcgacggcuuccagaacgagaccugggaccuguucguggagagaagcaaggccuucagcaacugcuaccccuacgacgugcccgacuacgccagccugagaagccugguggccagcagcggcacccuggaguucaucaccgagggcuucaccuggaccggcgugacccagaacggcggcagcaacgccugcaagagaggccccggcagcggcuucuucagcagacugaacuggcugaccaagagcggcagcaccuaccccgugcugaacgugaccaugcccaacaacgacaacuucgacaagcuguacaucuggggcgugcaccaccccagcaccaaccaggagcagaccagccuguacgugcaggccagcggcagagugaccgugagcaccaagagaagccagcagaccaucauccccaacaucggcagcagacccugggugagaggccccagcagcagaaucagcaucuacuggaccaccgugaagcccggcgacauccugaucaucaacagcaacggcaaccugaucgcccccagaggcuacuucaagaugagaaccggcaagagcagcaucaugagaagcgacgcccccaucggcgccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggccuguucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcgugaucaugugggccugccagaagggcaacaucagaugcaacaucugcaucuga

SEQ ID NO: 160996 - RNA, 1701 nt, Artificial Sequence; identical to SEQ ID NO: 152825
  derived and/or modified sequence opt4 from hemagglutinin__InfluenzaA__AFG71975

SEQ ID NO: 160997 - RNA, 1701 nt, Artificial Sequence
  derived and/or modified sequence opt4 from hemagglutinin__InfluenzaA__AFG71996
augaagaccaucaucgcccugagcuacaucuucugccuggugcugggccagaacuuccccggcaacgacaacagcaccgccacccugugccugggccaccacgccgugcccaacggcacccuggugaagaccaucaccaacgaccagaucgaggugaccaacgccaccgagcuggugcagagcagcagcaccggcaagaucugcaacaacccccacagaauccuggacggcaucgacugcacccugaucgacgcccugcugggcgacccccacugcgacggcuuccagaacgagaccugggaccuguucguggagagaagcaaggccuucagcaacugcuaccccuacgacgugcccgacuacgccagccugagaagccugguggccagcagcggcacccuggaguucaucaacgagggcuucaccuggaccggcgugacccagaacggcggcagcaacgccugcaagagaggccccgacaucggcuucuucagcagacugaacuggcuguacaagagcggcaacaccuaccccgugcugaacgugagcaugcccaacaacgacaacuucgacaagcuguacaucuggggcgugcaccaccccagcaccgaccaggagcagaccagccuguacgugcaggccagcggcagagugaccgugagcaccaagagaagccagcagaccaucauccccaacaucggcagcagacccugggugagaggccugagcagcagaaucagcaucuacuggaccaucgugaagcccggcgacauccuggugaucaacagcaacggcaaccugaucgcccccagaggcuacuucaagaugagaaccggcaagagcagcaucaugagaagcgacgccagcaucggcaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggcaucuucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagaaucaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 160998 - RNA, 1701 nt, Artificial Sequence
  derived and/or modified sequence opt4 from hemagglutinin__InfluenzaA__AFG72007
augaagaccaucaucgcccugagcuacaucuucugccuggugcugggcagagacuuccccagaaacgacaacagcaccgccacccugugccugggccaccacgccgugcccaacggcacccuggugaagaccaucaccaacgaccagaucgaggugaccaacgccaccgagcuggugcagagcagcagcaccggcaagaucugcaacaacccccacagaauccuggacggcauggacugcacccugaucgacgcccugcugggcgacccccacugcgacggccugcagaacggcaccugggaccuguucguggagagaagcaaggccuucagcaacugcuaccccuacgacgugcccgacuacgccagccugagaagccugguggccagcagcggcacccuggaguucaucaacgagggcuucaccuggaccggcgugacccagaacggcggcagcaacgccugcaagagaggccccgacagcggcuucuucagcagacugaacuggcuguacaagagcggcaacaccuaccccgugcugaacgugaccaugcccaacaacgacaacuucgacaagcuguacaucuggggcgugcaccaccccagcaccgaccaggaccagaccagccuguacgugcaggccagcggcagagugaccgugagcaccaagagaagccagcagaccgugauccccaacaucggccccagacccugggugagaggccugagcagcagaaucagcaucuacuggaccaucgugaagcccggcgacauccugcugaucaacagcaacggcaaccugaucgcccccagaggcuacuucaagaugagaaccggcaagagcagcaucaugagaagcgacgcccccaucggcaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggcaucuucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacagaugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 160999 - RNA, 1701 nt, Artificial Sequence
  derived and/or modified sequence opt4 from hemagglutinin__InfluenzaA__AFG72029
augaagaccaucaucgcccugagcuacaucuucugccugguguucggccagaaccugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacgagaagugggaccuguucguggagagaagcaaggccuucagcaacugcuaccccuacgacgugcccgacuacgccagccugagaagccugaucgccagcagcggcacccuggaguucaucaacgagggcuucaacuggaccggcgugacccagagcggcggcagcuacgccugcaagagaggcagcgacaacagcuucuucagcagacugaacuggcuguacgagagcgagagcaaguaccccgugcugaacgugaccaugcccaacaacggcaacuucgacaagcuguacaucuggggcgugcaccaccccagcaccgacaaggagcagaccaaccuguacgugagagccagcggcagagugaccgugagcaccaagagaagccagcagaccaucauccccaacaucggcagcagacccugggugagaggccugagcagcagaaucagcaucuacuggaccaucgugaagcccggcgacauccugcugaucaacagcaacggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161000 - RNA, 1701 nt, Artificial Sequence
  derived and/or modified sequence opt4 from hemagglutinin__InfluenzaA__AFG72040
augaagaccaucaucgcccugagcuacaucuucugccugguguucgcccagaaccugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugguggacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucaucaacgagagcuucaacuggaccggcgugacccagagcggcggcagcuacgccugcaagagaggcagcgacaacagcuucuucagcagacugaacuggcuguacgagagcgagagcaaguaccccgugcugaacgugaccaugcccaacaacggcaacuucgacaagcuguacaucuggggcgugcaccaccccagcaccgacaaggagcagaccaaccuguacgugagagccagcggcagagugaccgugagcaccaagagaagccagcagaccaucauccccaacaucggcagcagacccugggugagaggccugagcagcagaaucagcaucuacuggaccaucgugaagcccggcgacauccugcugaucaacagcaacggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggagaacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161001 - RNA, 1701 nt, Artificial Sequence
  derived and/or modified sequence opt4 from hemagglutinin__InfluenzaA__AFG72051
augaagaccaucaucgcccugagcuacaucuucugccugguguucgcccagaaccugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugguggacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucaucaacgagagcuucaacuggaccggcgugacccagagcggcggcagcuacgccugcaagagaggcagcgacaacagcuucuucagcagacugaacuggcuguacgagagcgagagcaaguaccccgugcugaacgugaccaugcccaacaacggcaacuucgacaagcuguacaucuggggcgugcaccaccccagcaccgacaaggagcagaccaaccuguacgugagagccagcggcagagugaccgugagcaccaagagaaaccagcagaccgugauccccaacaucggcagcagacccugggugagaggccugagcagcagaaucagcaucuacuggaccaucgugaagcccggcgacauccugcugaucaacagcaacggcaaccugaucgcccccagaggcuacuucaagauccacaacggcaagagcagcaucaugagaagcgacgcccccaucggcaccugcagcagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggcaucuucggcgccaucgccggcuucaucgagaacggcugggagggcaugguggacggcugguacggcuucagacacagaaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161002 - RNA, 1701 nt, Artificial Sequence
  derived and/or modified sequence opt4 from hemagglutinin__InfluenzaA__AFG72085
augaagaccaucaucgcccugagcuacaucuucugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacgagaagugggaccuguucguggagagaagcaaggccuacagcaacugcuaccccuacgacgugcccgacuacgccagccugagaagccugguggccagcagcggcacccuggaguucaucaacgaggacuucaacuggaucggcgugacccagagcggcggcagcugcgccugcaagagaggcagcgugaacagcuucuucagcagacugaacuggcugcacgagagcgagcagaaguaccccgcccugaacgugaccaugcccaacaacggcaaguucgacaagcuguacaucuggggcgugcaccaccccagcaccgacagagagcagaccaaccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaucggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacaagaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161003 - RNA, 1701 nt, Artificial Sequence
  derived and/or modified sequence opt4 from hemagglutinin__InfluenzaA__AFG72107
augaagaccaucaucgcccugagcuacaucuucugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacgagaagugggaccuguucguggagagaagcaaggccuucagcaacugcuaccccuacgacgugcccgacuacgccagccugagaagccugaucgccagcagcggcacccuggaguucaucaacgaggaguucaacuggaccggcgugacccagaacggcggcagcuacgccugcaagagaggcagcgugaacagcuucuucagcagacugaacuggcugcacgagagcgaguacaaguaccccgcccugaacgugaccaugcccaacaacggcagauucgacaagcuguacaucuggggcgugcaccaccccagcaccgacagagagcagaccaaccuguacgugagagccagcggcagagugaccgugagcaccaagagaagccagcagaccgugauccccaacaucggccccagacccugggugagaggccugagcagcagaaucagcaucuacuggaccaucgugaagcccggcgacauccugcugaucaacagcaccggcaaccugaucgcccccagaggcuacuucaagauccacaccggcaagagcagcaucaugagaagcgacgcccccaucggcaccugcagcagcgagugcaucacccccaacggcagcauccccaacgacaagcccuuccagaacgugaacaagaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggccgugaacaacagauuccagaucaagggcguggagcugaagagcggcuacaaggacuggauccuguggaucagcuucgccaucagcugcuuccugcugugcgugauccugcugggcuucaucaugugggccugccagaagggcaacaucagaugcaacaucugcaucuga

SEQ ID NO: 161004 - RNA, 1701 nt, Artificial Sequence
  derived and/or modified sequence opt4 from hemagglutinin__InfluenzaA__AFG72118
augaagaccaucaucgcccugagcuacaucuucugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagaacagcagcaccggcagaaucugcaacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccagagcggcggcagcuacgccugcaagagaggcagcgugaacagcuucuucagcagacugaacuggcugcacgagagcgaguacaaguaccccgcccugaacgugaccaugcccaacaacggcaaguucgacaagcuguacaucuggggcgugcaccaccccagcaccgacagagagcagaccaaccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagagacagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161005 - RNA, 1701 nt, Artificial Sequence
  derived and/or modified sequence opt4 from hemagglutinin__InfluenzaA__AFG72129
augaagaccaucaucgcccugagcuacaucuucugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccagagcggcggcagcuacgccugcaagagaggcagcgugaacagcuucuucagcagacugaacuggcugcacgagagcgaguacaaguaccccgcccugaacgugaccaugcccaacaacggcaaguucgacaagcuguacaucuggggcgugcaccaccccagcaccgacagagagcagaccaaccuguacgugagagccagcggcagagugaccgugagcaccaagagaagccagcagaccgugauccccaacaucggcagcagacccugggugagaggccugagcagcggcaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161006 - RNA, 1701 nt, Artificial Sequence
  derived and/or modified sequence opt4 from hemagglutinin__InfluenzaA__AFG72140
augaagaccaucaucgcccugagcuacaucuucugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccagagcggcggcagcuacgccugcaagagaggcagcgugaacagcuucuucagcagacugaacuggcugcacgagagcgaguacaaguaccccgcccugaacgugaccaugcccaacaacggcaaguucgacaagcuguacaucuggggcgugcaccaccccagcaccgacagagagcagaccaaccuguacgugagagcccugggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacaacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161007 - RNA, 1701 nt, Artificial Sequence
  derived and/or modified sequence opt4 from hemagglutinin__InfluenzaA__AFG72151
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaccaacgaggacuucaacuggaccggcguggcccagagcggcgagagcuacgccugcaagagaggcagcgugaagagcuucuucagcagacugaacuggcugcacgagagcgacuacaaguaccccgcccugaacgugaccaugcccaacaacggcaaguucgacaagcuguacaucuggggcgugcaccaccccagcaccgacagagagcagaccagccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161008 - RNA, 1701 nt, Artificial Sequence
  derived and/or modified sequence opt4 from hemagglutinin__InfluenzaA__AFG72184
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacgacuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccagagcggcgagagcuacgccugcaagagaggcagcgugaagagcuucuucagcagacugaacuggcugcacgagagcgaguacaaguaccccgcccugaacgugaccaugcccaacaacgacaaguucgacaagcuguacaucuggggcgugcaccaccccagcaccgagagagagcagaccagccuguacaucagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161009 - RNA, 1701 nt, Artificial Sequence; identical to SEQ ID NO: 161007
  derived and/or modified sequence opt4 from hemagglutinin__InfluenzaA__AFG72195

SEQ ID NO: 161010 - RNA, 1701 nt, Artificial Sequence
  derived and/or modified sequence opt4 from hemagglutinin__InfluenzaA__AFG72206
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcaagaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccagagcggcgagagcuacgccugcaagagaggcagcgugaagagcuucuucagcagacugaacuggcugcacgagagcgacuacaaguaccccgcccugaacgugaccaugcccaacaacggcaaguucgacaagcuguacaucuggggcgugcaccaccccagcaccgacagagagcagaccagccuguacaucagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161011 - RNA, 1701 nt, Artificial Sequence
  derived and/or modified sequence opt4 from hemagglutinin__InfluenzaA__AFG72217
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcggcagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcagagugaccgugagcaccaagagaagccagcagaccgugacccccaacaucggcagcagacccugggugagaggccugagcagcagaaucagcaucuacuggaccaucgugaagcccggcgacauccugcugaucagcagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgacaucaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggaccugauccuguggaucagcuucgccaucagcugcuuccugcugugcguggugcugcugggcuucaucaugugggccugccagaagggcaacaucagaugcaacaucugcaucuga

SEQ ID NO: 161012 - RNA, 1701 nt, Artificial Sequence
  derived and/or modified sequence opt4 from hemagglutinin__InfluenzaA__AFG72228
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaccaacgaggacuucaacuggaccggcguggcccagagcggcgagagcuacgccugcaagagaggcagcgugaagagcuucuucagcagacugaacuggcugcacgagagcgacuacaaguaccccgagcugaacgugaccaugcccaacaacggcaaguucgacaagcuguacaucuggggcgugcaccaccccagcaccgacagagagcagaccagccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161013 - RNA, 1701 nt, Artificial Sequence
  derived and/or modified sequence opt4 from hemagglutinin__InfluenzaA__AFG72239
augaagaccaucaucgcccugagcuacauccugugccuggugcuggcccagaagcugcccggcagcgacaacagcaccgccacccugugccugggccaccacgccgugcccaacggcacccuggugaagaccaucaccaacgaccagaucgaggugaccaacgccaccgagcuggugcagagcagcaccaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaccaacgaggacuucaacuggaccggcguggcccagagcggcgagagcuacgccugcaagagaggcagcgugaagagcuucuucagcagacugaacuggcugcacgagagcgacuacaaguaccccgcccugaacgugaccaugcccaacaacggcaaguucgacaagcuguacaucuggggcgugcaccaccccagcaccgacagagagcagaccagccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161014 - RNA, 1701 nt, Artificial Sequence; identical to SEQ ID NO: 161007
  derived and/or modified sequence opt4 from hemagglutinin__InfluenzaA__AFG72272

SEQ ID NO: 161015 - RNA, 1701 nt, Artificial Sequence
  derived and/or modified sequence opt4 from hemagglutinin__InfluenzaA__AFG72316
augaagaccaucaucgcccugagccacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcggcagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcagagugaccgugagcaccaagagaagccagcagaccgugacccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgugcccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161016 - RNA, 1701 nt, Artificial Sequence
  derived and/or modified sequence opt4 from hemagglutinin__InfluenzaA__AFG72339
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaucaacgaggacuucaacuggaccggcguggcccaggacggcggcagcuacaccugcaagagaggcagcgugaacagcuucuucagcagacugaacuggcugcacaagagcgaguacaaguaccccgcccugaacgugaccaugcccaacaacggcaaguucgacaagcuguacaucuggggcgugcaccaccccagcaccgacagcgaccagaccagccuguacgugagagccagcggcagagugaccgugagcaccaagagaagccagcagaccgugacccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaccugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161017 - RNA, 1701 nt, Artificial Sequence
  derived and/or modified sequence opt4 from hemagglutinin__InfluenzaA__AFG72350
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaucaacgaggacuucaacuggaccggcguggcccaggacggcagaagcuacgccugcaagagaggcagcgugaacagcuucuucagcagacugaacuggcugcacaagagcgaguacaaguaccccgcccugaacgugaccaugcccaacaacggcaaguucgacaagcuguacaucuggggcgugcaccaccccagcaccgacagcgaccagaccagccuguacgugagagccagcggcagagugaccgugagcaccaagagaagccagcagaccgugacccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaucugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161018 - RNA, 1701 nt, Artificial Sequence
  derived and/or modified sequence opt4 from hemagglutinin__InfluenzaA__AFG72372
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcaagagcuacaccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161019 - RNA, 1701 nt, Artificial Sequence; identical to SEQ ID NO: 153544
  derived and/or modified sequence opt4 from hemagglutinin__InfluenzaA__AFG72383

SEQ ID NO: 161020 - RNA, 1701 nt, Artificial Sequence
  derived and/or modified sequence opt4 from hemagglutinin__InfluenzaA__AFG72394
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcagagugaccguggccaccaagagaagccagcagaccgugauccccaacaucggcuucagacccugggugagaggccagagcagcggcaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccggccugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161021 - RNA, 1701 nt, Artificial Sequence
  derived and/or modified sequence opt4 from hemagglutinin__InfluenzaA__AFG72405
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgaccccaacugcgacggcuuccagaacaaggagugggaccuguucguggagagaagcaaggccuacagcaacugcuaccccuacgacgugcccgacuacgccagccugagaagccugguggccagcagcggcacccuggaguucaccaacgaggacuucaacuggaccggcguggcccaggacggcggcagcuacgccugcaagagaggcagcgugaagagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcagagugaccgugagcaccaagagaagccagcagaccgugacccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaccugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161022 - RNA, 1701 nt, Artificial Sequence
  derived and/or modified sequence opt4 from hemagglutinin__InfluenzaA__AFG72449
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcuacagcccccacagaauccuggacggcaacaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcaagagcuacgccugcaagagaggcagcgugaagggcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcggcgugaccgugagcaccaagagaagccagcagaccgugauccccagcaucggcagcagacccugggugagaggccugagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161023 - RNA, 1701 nt, Artificial Sequence; identical to SEQ ID NO: 153573
  derived and/or modified sequence opt4 from hemagglutinin__InfluenzaA__AFG72460

SEQ ID NO: 161024 - RNA, 1701 nt, Artificial Sequence
  derived and/or modified sequence opt4 from hemagglutinin__InfluenzaA__AFG72504
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcaagagcuacgccugcaagagaggcagcgugaagagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcagagugaccgugagcaccaagagaagccagcagaccgugauccccaacaucggcuucagacccugggugagaggccugagcagcagaaucagcaucuacuggaccaucgugaagcccggcgacauccugcugaucaacagcaccggcaaccugaucgcccccagaggcuacuucaagaucagaaacggcaagagcagcaucaucagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccggccugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161025 - RNA, 1701 nt, Artificial Sequence
  derived and/or modified sequence opt4 from hemagglutinin__InfluenzaA__AFG72515
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagccccaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgagaacuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcagagugaccgugagcaccaagagaagccagcagaccgugauccccgacaucggcuacagacccugggugagaggccugagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugguggagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161026 - RNA, 1701 nt, Artificial Sequence
  derived and/or modified sequence opt4 from hemagglutinin__InfluenzaA__AFG72526
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcagcugcuaccccuacgacgugcccgacuacgccagccugagaagccugguggccagcagcggcacccuggaguucaucaacgaggacuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcagagugaucgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccagaccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161027 - RNA, 1701 nt, Artificial Sequence
  derived and/or modified sequence opt4 from hemagglutinin__InfluenzaA__AFG72581
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcggcgugaccgugagcaccaagagaagccagcagaccgugauccccaacaucggcuacagacccugggugagaggccugagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcaucagcaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161028 - RNA, 1701 nt, Artificial Sequence
  derived and/or modified sequence opt4 from hemagglutinin__InfluenzaA__AFG72603
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaccaaggagggcuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcaucagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcaagagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaccgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161029 - RNA, 1701 nt, Artificial Sequence
  derived and/or modified sequence opt4 from hemagglutinin__InfluenzaA__AFG72614
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaccaacgagggcuucaacuggaccggcguggcccaggacggcaccagcuacagcugcaagagaggcagcgugaagagcuucuucagcagacugaacuggcugcacaagcuggaguacaaguaccccgcccugaacguggccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161030 - RNA, 1701 nt, Artificial Sequence
  derived and/or modified sequence opt4 from hemagglutinin__InfluenzaA__AFG72625
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaccaacgagggcuucaacuggaccggcguggcccaggacggcaccagcuacgccugcaagagaggcagcgugaagagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcaucagcagcagaaucagcaucuacuggaccaucgugaagcccggcgacauccugcugaucaagagcaccggcaaccugaucgcccccagaggcuacuucaagaucagaagcggcaagagcagcaucaugagaagcgacgcccccaucggcaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161031 - RNA, 1701 nt, Artificial Sequence
  derived and/or modified sequence opt4 from hemagglutinin__InfluenzaA__AFG72636
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaccaacgagggcuucaacuggaccggcguggcccaggacggcaagagcuacgccugcaagagaggcagcgugaagagcuucuucagcagacugaacuggcugcacaagcuggaguucaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcaucagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucgacaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161032 - RNA, 1701 nt, Artificial Sequence
  derived and/or modified sequence opt4 from hemagglutinin__InfluenzaA__AFG72658
augaagaccaucaucgcccugagcuacauccugugccuggccuucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaccaacgagggcuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcaucagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucgacaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161033 - RNA, 1701 nt, Artificial Sequence
  derived and/or modified sequence opt4 from hemagglutinin__InfluenzaA__AFG72680
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcaucaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaccaacgagggcuucaacuggaccggcguggcccaggacggcaccagcuacgccugcaagagaggcagcgugaagagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccagaagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacagaaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161034 - RNA, 1701 nt, Artificial Sequence
  derived and/or modified sequence opt4 from hemagglutinin__InfluenzaA__AFG72691
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuucaagaacaaggagugggaccuguucguggagagaagcaccgccuacagcaacugcuaccccuacgacgugcccgacuacgccagccugagaagccugguggccagcagcggcacccuggaguucaccaacgagggcuucaacuggaccggcguggcccaggacggcaccagcuacgccugcaagagaggcagcgugaagagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucgacaacugcaacagcgagugcaucacccccaacggcagcauccccaacggcaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161035 - RNA, 1701 nt, Artificial Sequence
  derived and/or modified sequence opt4 from hemagglutinin__InfluenzaA__AFG72713
augaagaucaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcaagaacugcacccugaucgacgcccugcugggcgacccccacugcgacggcuucaagaacaaggagugggaccuguucguggagagaagcaccgccuacagcaacugcuaccccuacgacgugcccgacuacgccagccugagaagccugguggccagcagcggcacccuggaguucaccaacgagggcuucaacuggaccggcguggcccaggacggcaccagcuacgccugcaagagaggcagcgugaagagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcaucagcagcagaaucagcaucuacuggaccaucgugaagcccggcgacauccugcugaucagcagcaccggcaaccugaucgcccccagaggcuacuucaagaucagaagcggcaagagcagcaucaucagaagcgacgcccccaucgacaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161036 - RNA, 1701 nt, Artificial Sequence
  derived and/or modified sequence opt4 from hemagglutinin__InfluenzaA__AFG72724
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaccaacgagggcuucaacuggaccggcguggcccaggacggcaccagcuacgccugcaagagaggcagcgugaagagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucgacaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgugugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161037 - RNA, 1701 nt, Artificial Sequence
  derived and/or modified sequence opt4 from hemagglutinin__InfluenzaA__AFG72735
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuucaagaacaaggagugggaccuguucguggagagaagcaccgccuacagcaacugcuaccccuacgacgugcccgacuacgccagccugagaagccugguggccagcagcggcacccuggaguucaccaacgagggcuucaacuggaccggcguggcccaggacggcaccagcuacgccugcaagagaggcagcgugaagagcuucuucagcagacugaacuggcugcacaagcuggaguacaaguaccccgcccugaccgugaccaugcccaacaacgacaaguucgacaagcuguacaucuggggcgugcaccaccccagcaccgacagcgaccagaccagcaucuacgugcaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucgacaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgacaucuggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161038 - RNA, 1701 nt, Artificial Sequence
  derived and/or modified sequence opt4 from hemagglutinin__InfluenzaA__AFG72757
augaagaccaucaucgcccugagcuacauccugugccugguguucgcccagaagauccccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcuacgccugcaagagaagcagcaucaagagcuucuucagcagacugaacuggcugcaccagcugaaguacaaguaccccgcccugaacgugaccaugcccaacaacgacaaguucgacaagcuguacaucuggggcgugcaccaccccagcaccgacagcgaccagaccagcaucuacgcccaggccagcggcagagugaccgugagcaccaagagaagccagcagaccgugauccccaacaucggcagcagacccugggugagaggcaucagcagcagaaucagcauccacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161039 - RNA, 1701 nt, Artificial Sequence
  derived and/or modified sequence opt4 from hemagglutinin__InfluenzaA__AFG72779
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgacaaguucgacaagcuguacaucuggggcgugcaccaccccagcaccgacagcgaccagaccagccuguacgcccaggccagcggcagagugaccgugagcaccagaagaagccagcagaccgugauccccaacaucggcagcagacccugggugagaggcgugagcagcggcaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161040 - RNA, 1701 nt, Artificial Sequence
  derived and/or modified sequence opt4 from hemagglutinin__InfluenzaA__AFG72801
augaagaccaucaucgcccugagcuacauccugugccugguguucgcccagaagcugcccggcaacgacaacagcaccgccacccugugccugggccaccacgccgugagcaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagcaucuacgcccagagcagcggcagagugaccgugagcaccaagagaagccagcagaccgugauccccaacaucggcagcagccccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161041 - RNA, 1701 nt, Artificial Sequence
  derived and/or modified sequence opt4 from hemagglutinin__InfluenzaA__AFG72812
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccugaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 161042 - RNA, 1701 nt, Artificial Sequence
  derived and/or modified sequence opt4 from hemagglutinin__InfluenzaA__AFG72823
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcugcaccccggcaccgacagcgaccagaucagccuguacgcccaggccagcggcagaaucaccgugagcaccaagagaagccagcagaccgugauccccaacaucggcagcagacccagagugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacaucaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161043 - RNA, 1701 nt, Artificial Sequence
  derived and/or modified sequence opt4 from hemagglutinin__InfluenzaA__AFG72834
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagauccagagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 161044 - RNA, 1701 nt, Artificial Sequence
  derived and/or modified sequence opt4 from hemagglutinin__InfluenzaA__AFG72845
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccagcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugagauacaaguaccccgcccugaacgugaccaugcccaacaacgagaaguucgacaagcuguacaucuggggcgugcaccaccccggcaccgacagcgaccagaucagccuguacgcccaggccagcggcagagugaccaucagcaccaagagaagccagcagaccgugauccccaacaucggcagcagacccugggugagaggcgugagcagcagaaucagcauccacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaagacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 161045 - RNA, 1701 nt, Artificial Sequence
  derived and/or modified sequence opt4 from hemagglutinin__InfluenzaA__AFG72856
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugaucgccagcagcggcacccuggaguucaccaacgagagcuucaacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacaucagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacaagcugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161046 - RNA, 1701 nt, Artificial Sequence
  derived and/or modified sequence opt4 from hemagglutinin__InfluenzaA__AFG72867
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaagaacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccagagugagagacaucagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 161047 - RNA, 1701 nt, Artificial Sequence
  derived and/or modified sequence opt4 from hemagglutinin__InfluenzaA__AFG72922
augaagaccaucaucgcccugagcuacauccugugccugguguucgcccagaagcugcccggcgacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcagcugcaucagaaagagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161048 - RNA, 1701 nt, Artificial Sequence
  derived and/or modified sequence opt4 from hemagglutinin__InfluenzaA__AFG72933
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcgugagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161049 - RNA, 1701 nt, Artificial Sequence
  derived and/or modified sequence opt4 from hemagglutinin__InfluenzaA__AFG72955
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugaucgccagcagcggcacccuggaguucaacaacgagagcuucaacuggaccggcgugacccagaacggcaccagcagcgccugcaucagaagaagcaacaacagcuucuucagcagacugaacuggcugacccaccugagauucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161050 - RNA, 1701 nt, Artificial Sequence; identical to SEQ ID NO: 154160
  derived and/or modified sequence opt4 from hemagglutinin__InfluenzaA__AFG98808

SEQ ID NO: 161051 - RNA, 1701 nt, Artificial Sequence; identical to SEQ ID NO: 154160
  derived and/or modified sequence opt4 from hemagglutinin__InfluenzaA__AFG98819

SEQ ID NO: 161052 - RNA, 1701 nt, Artificial Sequence
  derived and/or modified sequence opt4 from hemagglutinin__InfluenzaA__AFG98830
augaagaccaucaucgcccugagcuacaucuucugccuggugcugggccaggaccugcccggcaacgacaagagcaccgccacccugugccugggccaccacgccgugcccaacggcacccuggugaagaccaucaccaacgaccagaucgaggugaccaacgccaccgagcuggugcagagcagcagcaccggcaagaucugcaacaacccccacagaauccuggacggcaucgacugcacccugaucgacgcccugcugggcgacccccacugcgacggcuuccagaacgagaccugggaccuguucguggagagaagcaaggccuucagcaacugcuaccccuacgacgugcccgacuacgccagccugagaagccugguggccagcagcggcacccuggaguucaucaccgagggcuucaccuggaccggcgugacccagaacggcggcagcagcgccugcaagagaggccccggcagcggcuucuucagcagacugaacuggcugaccaagagcggcagcaccuaccccgugcugaacgugaccaugcccaacaacgacaacuucgacaagcuguacaucuggggcgugcaccaccccagcaccaaccaggagcagaccagccuguacgugcaggccagcggcagagugaccgugagcaccagaagaagccagcagaccaucauccccaacaucggcagcagacccugggugagaggccugagcagcagaaucagcaucuacuggaccaucgugaagcccggcgacauccugaucaucaacagcaacggcaaccugaucgcccccagaggcuacuucaagaugagaaccggcaagagcagcaucaugagaagcgacgcccccaucgacaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggccuguucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161053 - RNA, 1701 nt, Artificial Sequence
  derived and/or modified sequence opt4 from hemagglutinin__InfluenzaA__AFG98841
augaagaccaucaucgcccugagcuacaucuucugccuggugcugggccaggaccugcccggcaacgacaagagcaccgccacccugugccugggccaccacgccgugcccaacggcacccuggugaagaccaucaccaacgaccagaucgaggugaccaacgccaccgagcuggugcagagcagcagcaccggcaagaucugcaacaacccccacagaauccuggacggcaucgacugcacccugaucgacgcccugcugggcgacccccacugcgacggcuuccagaacgagaccugggaccuguucguggagagaagcaaggccuucagcaacugcuaccccuacgacgugcccgacuacgccagccugagaagccugguggccagcagcggcacccuggaguucaucaccgagggcuucaccuggaccggcgugacccagaacggcggcagcaacgccugcaagagaggccccggcagcggcuucuucagcagacugaacuggcugaccaagagcggcagcaccuaccccgugcugaacgugaccaugcccaacaacgacaacuucgacaagcuguacaucuggggcgugcaccaccccagcaccaaccaggagcagaccagccuguacgugcaggccagcggcagagugaccgugagcaccagaagaagccagcagaccaucauccccaacaucggcagcagacccugggugagaggccugagcagcagaaucagcaucuacuggaccaucgugaagcccggcgacauccugaucaucaacagcaacggcaaccugaucgcccccagaggcuacuucaagaugagaaccggcaagagcagcaucaugagaagcgacgcccccaucggcaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggccuguucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161054 - RNA, 1701 nt, Artificial Sequence; identical to SEQ ID NO: 152825
  derived and/or modified sequence opt4 from hemagglutinin__InfluenzaA__AFG98852

SEQ ID NO: 161055 - RNA, 1701 nt, Artificial Sequence
  derived and/or modified sequence opt4 from hemagglutinin__InfluenzaA__AFG98863
augaagaccaucaucgcccugagcuacaucuucugccuggugcugggccaggaccugcccggcaacgacaacagcaccgccacccugugccugggccaccacgccgugcccaacggcacccuggugaagaccaucaccaacgaccagaucgaggugaccaacgccaccgagcuggugcagagcagcagcaccggcaagaucugcaacaacccccacagaauccuggacggcaucgacugcacccugaucgacgcccugcugggcgacccccacugcgacggcuuccagaacgagaccugggaccuguucguggagagaagcaaggccuucagcaacugcuaccccuacgacgugcccgacuacgccagccugagaagccugguggccagcagcggcacccuggaguucaucaacgagggcuucaccuggaccggcgugacccagaacggcggcagcagcgccugcaagagaggccccgacagcggcuucuucagcagacugaacuggcuguacaagagcggcagcaccuaccccgugcugaacgugaccaugcccaacaacgacaacuucgacaagcuguacaucuggggcgugcaccaccccagcaccaaccaggagcagaccagccuguacgugcaggccagcggcagagugaccgugagcaccaagagaagccagcagaccaucauccccaacaucggcagcagacccugggugagaggccugagcagcagaaucagcaucuacuggaccaucgugaagcccggcgacauccuggugaucaacagcaacggcaaccugaucgcccccagaggcuacuucaagaugagaaccggcaagagcagcaucaugagaagcgacgcccccaucggcaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggccuguucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucagaaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161056 - RNA, 1701 nt, Artificial Sequence
  derived and/or modified sequence opt4 from hemagglutinin__InfluenzaA__AFG98874
augaagaccaucaucgcccugagcuacaucuucugccuggugcugggccaggacuuccccggcaacgacaacagcaccgccacccugugccugggccaccacgccgugcccaacggcacccuggugaagaccaucaccaacgaccagaucgaggugaccaacgccaccgagcuggugcagagcagcagcaccggcaagaucugcaacaacccccacagaauccuggacggcaucgacugcacccugaucgacgcccugcugggcgacccccacugcgacggcuuccagaacgagaccugggaccuguucguggagagaagcaaggccuucagcaacugcuaccccuacgacgugcccgacuacgccagccugagaagccugguggccagcagcggcacccuggaguucaucaacgagggcuucaccuggaccggcgugacccagaacggcggcagcaacgccugcaagagaggccccgacaacggcuucuucagcagacugaacuggcuguacaagagcggcagcaccuaccccgugcugaacgugaccaugcccaacaacgacaacuucgacaagcuguacaucuggggcgugcaccaccccagcaccgaccaggagcagaccagccuguacgugcaggccagcggcagagugaccgugagcaccaagagaagccagcagaccaucauccccaacaucggcagcagacccugggugagaggccugagcagcagaaucagcaucuacuggaccaucgugaagcccggcgacauccuggugaucaacagcaacggcaaccugaucgcccccagaggcuacuucaagaugagaaccggcaagagcagcaucaugagaagcgacgcccccaucggcaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggccuguucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161057 - RNA, 1701 nt, Artificial Sequence
  derived and/or modified sequence opt4 from hemagglutinin__InfluenzaA__AFG98885
augaagaccaucaucgcccugagcuacaucuucugccuggugcugggccaggacuuccccggcaacgacaacagcaccgccacccugugccugggccaccacgccgugcccaacggcacccuggugaagaccaucaccaacgaccagaucgaggugaccaacgccaccgagcuggugcagagcagcagcaccggcaagaucugcaacaacccccacagaauccuggacggcaucgacugcacccugaucgacgcccugcugggcgacccccacugcgacggcuuccagaacgagaccugggaccuguucguggagagaagcaaggccuucagcaacugcuaccccuacgacgugcccgacuacgccagccugagaagccugguggccagcagcggcacccuggaguucaucaacgagggcuucaccuggaccggcgugacccagaacggcggcagcaacgccugcaagagaggcaccgacagcggcuucuucagcagacugaacuggcuguacaagagcggcagcaccuaccccgugcugaacgugaccaugcccaacaacgacaacuucgacaagcuguacaucuggggcgugcaccaccccagcaccgaccaggagcagaccagccuguacgugcaggccagcggcagagugaccgugagcaccaagagaagccagcagaccaucauccccaacaucggcagcagacccugggugagaggccugagcagcagaaucagcaucuacuggaccaucgugaagcccggcgacauccuggugaucaacagcaacggcaaccugaucgcccccagaggcuacuucaagaugagaaccggcaagagcagcaucaugagaagcgacgcccccaucggcaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggccuguucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161058 - RNA, 1701 nt, Artificial Sequence
  derived and/or modified sequence opt4 from hemagglutinin__InfluenzaA__AFG98896
augaagaccaucaucgcccugagcuacaucuucugccuggugcugggccaggacuuccccggcaacgacaacagcaccgccacccugugccugggccaccacgccgugcccaacggcacccuggugaagaccaucaccaacgaccagaucgaggugaccaacgccaccgagcuggugcagagcagcagcaccggcaagaucugcaacaacccccacagaauccuggacggcaucaacugcacccugaucgacgcccugcugggcgacccccacugcgacggcuuccagaacgagaccugggaccuguucguggagagaagcaaggccuucagcaacugcuaccccuacgacgugcccgacuacgccagccugagaagccugguggccagcagcggcacccuggaguucaucaacgagggcuucaccuggaccggcgugacccagaacggcggcagcaacgccugcaagagaggccccgacagcggcuucuucagcagacugaacuggcuguacaagagcggcagcgccuaccccgugcugaacgugaccaugcccaacaacgacaacuucgacaagcuguacaucuggggcgugcaccaccccagcaccgaccaggagcagaccaaccuguacgugcagaccagcggcagagugaccgugagcaccaagagaagccagcagaccaucauccccaacaucggcagcagacccugggugagaggccugagcagcagaaucagcaucuacuggaccaucgugaagcccggcgacauccuggugaucaacagcaacggcaaccugaucgcccccagaggcuacuucaagaugagaaccggcaagagcagcaucaugagaagcgacgcccccaucggcaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggcaucuucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161059 - RNA, 1701 nt, Artificial Sequence
  derived and/or modified sequence opt4 from hemagglutinin__InfluenzaA__AFG98907
augaagaccaucaucgcccugagcuacaucuucugccuggugcugggccaggaccugcccggcaacgacaacagcaccgccacccugugccugggccaccacgccgugcccaacggcacccuggugaagaccaucaccaacgaccagaucgaggugaccaacgccaccgagcuggugcagagcagcagcaccggcaagaucugcaacaacccccacagaauccuggacggcaucaacugcacccugaucgacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucaucaacgagggcuucaacuggaccggcgugacccagaacggcggcagcaacgccugcaagagaggccccgacugcggcuucuucagcagacugaacuggcuguacaagagcggcagcaccuaccccgugcugaacgugaccaugcccaacaacgacaacuucgacaagcuguacaucuggggcgugcaccaccccagcaccgaccaggagcagaccaaccuguacgugcaggccagcggcagagugaccgugagcaccaagagaagccagcagaccaucauccccaacaucggcagcagacccugggugagaggccugagcagcagaaucagcaucuacuggaccaucgugaagcccggcgacauccuggugaucaacagcaacggcaaccugaucgcccccagaggcuacuucaagaugagaaccggcaagagcagcaucaugagaagcgacgcccccaucggcaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggcaucuucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161060 - RNA, 1701 nt, Artificial Sequence
  derived and/or modified sequence opt4 from hemagglutinin__InfluenzaA__AFG98918
augaagaccaucaucgcccugagcuacaucuucugccuggugcugggccaggaccugcccggcaacgacaacagcaccgccacccugugccugggccaccacgccgugcccaacggcacccuggugaagaccaucaccaacgaccagaucgaggugaccaacgccaccgagcuggugcagagcagcagcaccggcaagaucugcaacaacccccacagaauccuggacggcaucaacugcacccugaucgacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucaucaacgagggcuucaacuggaccggcgugacccagaacggcggcagcaacgccugcaagagaggccccgacagaggcuucuucagcagacugaacuggcuguacaagagcggcagcaccuaccccgugcugaacgugaccaugcccaacaacgacaacuucgacaagcuguacaucuggggcgugcaccaccccagcaccgaccaggagcagaccaaccuguacgugcaggccagcggcagagugaccgugagcaccaagagaagccagcagaccaucauccccaacaucggcagcagacccugggugagaggccugagcagcagaaucagcaucuacuggaccaucgugaagcccggcgacauccuggugaucaacagcaacggcaaccugaucgcccccagaggcuacuucaagaugagaaccggcaagagcagcaucaugagaagcgacgcccccaucggcaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggcaucuucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161061 - RNA, 1701 nt, Artificial Sequence
  derived and/or modified sequence opt4 from hemagglutinin__InfluenzaA__AFG98929
augaagaccgugaucgcccugagcuacaucuucugccuggugcugggccaggaccugcccggcaacgacaacagcaccgccacccugugccugggccaccacgccgugcccaacggcacccuggugaagaccaucaccaacgaccagaucgaggugaccaacgccaccgagcuggugcagagcagcagcaccggcaagaucugcaacaacccccacagaauccuggacggcaucaacugcacccugaucgacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucaucaacgagggcuucaacuggaccggcgugacccagaacggcggcagcaacgccugcaagagaggccccgacaucggcuucuucagcagacugaacuggcuguacaagagcggcagcaccuaccccgugcugaacgugaccaugcccaacaacgacaacuucgacaagcuguacaucuggggcgugcaccaccccagcaccgaccaggagcagaccaaccuguacgugcaggccagcggcagagugaccgugagcaccaagagaagccagcagaccaucauccccaacaucggcagcagacccugggugagaggccugagcagcagaaucagcaucuacuggaccaucgugaagcccggcgacauccuggugaucaacagcaacggcaaccugaucgcccccagaggcuacuucaagaugagaaccggcaagagcagcaucaugagaagcgacgcccccaucggcaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggcaucuucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161062 - RNA, 1701 nt, Artificial Sequence
  derived and/or modified sequence opt4 from hemagglutinin__InfluenzaA__AFG98940
augaagaccaucaucgcccugagcuacaucuucugccuggugcugggccaggaccugcccggcaacgacaacagcaccgccacccugugccugggccaccacgccgugcccaacggcacccuggugaagaccaucaccaacgaccagaucgaggugaccaacgccaccgagcuggugcagagcagcagcaccggcaagaucugcaacaacccccacagaauccuggacggcaucaacugcacccugaucgacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucaucaacgagggcuucaacuggaccggcgugacccagaacggcggcagcaacgccugcaagagaggccccgacagcggcuucuucagcagacugaacuggcuguacaagagcggcagcaccuaccccgugcugaacgugaccaugcccaacaaggacaacuucgacaagcuguacaucuggggcgugcaccaccccagcaccgaccaggagcagaccaaccuguacgugcaggccagcggcagagugaccgugagcaccaagagaagccagcagaccaucauccccaacaucggcagcagacccugggugagaggcaugagcagcagaaucagcaucuacuggaccaucgugaagcccggcgacauccuggugaucaacagcaacggcaaccugaucgcccccagaggcuacuucaagaugagaaccggcagaagcagcaucaugagaagcgacgcccccaucggcaccugcaucagcgagugcaucacccccaacggcagcauccccaacgacagacccuuccagaacgugaacaagaucaccuacggcgccugccccaaguacgugaagcagaacacccugaagcuggccaccggcaugagaaacgugcccgagaagcagaccagaggcaucuucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucgagagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161063 - RNA, 1701 nt, Artificial Sequence
  derived and/or modified sequence opt4 from hemagglutinin__InfluenzaA__AFG98962
augaagaccaucaucgcccugagcuacaucuucugccuggugcuggcccaggaccugcccggcaacgacaacagcaccgccacccugugccugggccaccacgccgugcccaacggcacccuggugaagaccaucaccaacgaccagaucgaggugaccaacgccaccgagcuggugcagagcagcagcaccggcaagaucugcaacaacccccacagaauccuggacggcaucaacugcacccugaucgacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucaucaacgagggcuucaacuggaccggcgugacccagaacggcggcagcaacgccugcaagagaggccccgacagcggcuucuucagcagacugaacuggcuguacaagagcggcagcaccuaccccgugcugaacgugaccaugcccaacaacgacaacuucgacaagcuguacaucuggggcgugcaccaccccagcaccgaccaggagcagaccaaccuguacgugcaggccagcggcagagugaccgugagcaccaagagaagccagcagaccaucauccccaacgugggcagcagacccugggugagaggccugagcagcagaaucagcaucuacuggaccaucgugaagcccggcgacauccuggugaucaacagcaacggcaaccugaucgcccccagaggcuacuucaagaugagaaccggcaagagcagcaucaugagaagcgacgcccccaucggcaccugcagcagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggcaucuucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161064 - RNA, 1701 nt, Artificial Sequence
  derived and/or modified sequence opt4 from hemagglutinin__InfluenzaA__AFG98973
augaagaccaucaucgcccugagcuacaucuucugccuggugcugggccaggacuuccccagaaacgacaacagcaccgccacccugugccugggccaccacgccgugcccaacggcacccuggugaagaccaucaccaacgaccagaucgaggugaccaacgccaacgagcuggugcagagcagcagcaccggcaagaucugcaacaacccccacagaauccuggacggcauggacugcacccugaucgacgcccugcugggcgacccccacugcgacggccugcagaacgagaccugggaccuguucguggagagaagcaaggccuucagcaacugcuaccccuacgacgugcccgacuacgccagccugagaagccugguggccagcagcggcacccuggaguucaucaacgagggcuucaccuggaccggcgugacccagaacggcggcagcaacgccugcaagagaggccccgacagaggcuucuucagcagacugaacuggcuguacaagagcggcaacaccuaccccgugcugaacgugaccaugcccaacaacgacaacuucgacaagcuguacaucuggggcgugcaccaccccagcaccgaccaggaccagaccagccuguacgugcaggccagcggcagagugaccgugagcaccaagagaagccagcagaccgugauccccaacaucggccccagacccugggugagaggccugagcagcggcaucagcaucuacuggaccaucgugaagcccggcgacauccugcugaucaacagcaacggcaaccugaucgcccccagaggcuacuucaagaugagaaccggcaagagcagcaucaugagaagcgacgcccccaucggcaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggcaucuucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacagaugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161065 - RNA, 1701 nt, Artificial Sequence
  derived and/or modified sequence opt4 from hemagglutinin__InfluenzaA__AFG98984
augaagaccaucaucgcccugagcuacaucuucugccuggugcugggccaggacuuccccagaaacgacaacagcaccgccacccugugccugggccaccacgccgugcccaacggcacccuggugaagaccaucaccaacgaccagaucgaggugaccaacgccaccgagcuggugcagagcagcagcaccggcaagaucugcaacaacccccacagaauccuggacggcauggacugcacccugaucgacgcccugcugggcgacccccacugcgacggccugcagaacgagaccugggaccuguucguggagagaagcaaggccuucagcaacugcuaccccuacgacgugcccgacuacgccagccugagaagccugguggccagcagcggcacccuggaguucaucaacgagggcuucaccuggaccggcgugacccagaacggcggcagcaacgccugcaagagaggccccgacagaggcuucuucagcagacugaacuggcuguacaagagcggcaacaccuaccccgugcugaacgugaccaugcccaacaacgacaacuucgacaagcuguacaucuggggcgugcaccaccccagcaccgaccaggaccagaccagccuguacgugcaggccagcggcagagugaccgugagcaccaagagaagccagcagaccgugauccccaacaucggccccagacccugggugagaggccugagcagcggcaucagcaucuacuggaccaucgugaagcccggcgacauccugcugaucaacagcaacggcaaccugaucgcccccagaggcuacuucaagaugagaaccggcaagagcagcaucaugagaagcgacgcccccaucggcaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggcaucuucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacagaugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161066 - RNA, 1704 nt, Artificial Sequence
  derived and/or modified sequence opt4 from hemagglutinin__InfluenzaA__AFG98995
augaagaccaucaucgcccugagcuacaucuucugccugguguucgcccaggaccugcccggcaacgacaacaacagcaccgccacccugugccugggccaccacgccgugcccaacggcacccuggugaagaccaucaccaacgaccagaucgaggugaccaacgccaccgagcuggugcagagcagcagcaccggcaagaucugcaacaacccccacagaauccuggacggcaucaacugcacccugaucgacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucaucaacgagggcuucaacuggaccggcgugacccagaacggcggcagcaacgccugcaagagaggccccgacaucggcuucuucagcagacugaacuggcuguacaagagcggcagcaccuaccccgugcagaacgugaccaugcccaacaacgacaacagcgacaagcuguacaucuggggcgugcaccaccccagcaccgacaaggagcagaccgaccuguacgugcaggccagcggcaaggugaccgugagcaccaagagaagccagcagaccaucauccccaacgugggcagcagacccugggugagaggccugagcagcagaaucagcaucuacuggaccaucgugaagcccggcgacauccuggugaucaacagcaacggcaaccugaucgcccccagaggcuacuucaagaugagaaccggcaagagcagcaucaugagaagcgacgcccccaucggcaccugcagcagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggcaucuucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161067 - RNA, 1701 nt, Artificial Sequence
  derived and/or modified sequence opt4 from hemagglutinin__InfluenzaA__AFG99006
augaagaccaucaucgcccugagcuacaucuucugccuggugcugggccaggacuuccccagaaacgacaacagcaccgccacccugugccugggccaccacgccgugcccaacggcacccuggugaagaccaucaccaacgaccagaucgaggugaccaacgccaccgagcuggugcagagcagcagcaccggcaagaucugcaacaacccccacagaauccuggacggcauggacugcacccugaucgacgcccugcugggcgacccccacugcgacggccugcagaacgagaccugggaccuguucguggagagaagcaaggccuucagcaacugcuaccccuacgacgugcccgacuacgccagccugagaagccugguggccagcagcggcacccuggaguucaucaacgagggcuucaccuggaccggcgugacccagaacggcggcagcaacgccugcaagagaggccccgacagaggcuucuucagcagacugaacuggcuguacaagagcggcaacaccuaccccgugcugaacgugaccaugcccaacaacgacaacuucgacaagcuguacaucuggggcgugcaccaccccagcaccgaccaggaccagaccagccuguacgugcaggccagcggcagagugaccgugagcaccaagagaagccagcagaccgugauccccaacaucggccccagacccugggugagaggccugagcagcagaaucagcaucuacuggaccaucgugaagcccggcgacauccugcugaucaacagcaacggcaaccugaucgcccccagaggcuacuucaagaugagaaccggcaagagcagcaucaugagaagcgacgcccccaucggcaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggcaucuucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacagaugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161068 - RNA, 1701 nt, Artificial Sequence; identical to SEQ ID NO: 153284
  derived and/or modified sequence opt4 from hemagglutinin__InfluenzaA__AFG99017

SEQ ID NO: 161069 - RNA, 1701 nt, Artificial Sequence
  derived and/or modified sequence opt4 from hemagglutinin__InfluenzaA__AFG99028
augaagaccaucaucgcccugagcuacaucuucugccugguguucgcccaggaccugcccggcaacgacaacagcaccgccacccugugccugggccaccacgccgugcccaacggcacccuggugaagaccaucaccaacgaccagaucgaggugaccaacgccaccgagcuggugcagagcagcagcaccggcaagaucugcggcaacccccacagaauccuggacggcaucaacugcacccugaucgacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucaucaacgagggcuucaacuggaccggcgugacccagaacggcggcagcagcgccugcaagagaggccccgacaacggcuucuucagcagacugaacuggcuguacaagagcggcagcaccuaccccgugcagaacgugaccaugcccaacaacgacaacagcgacaagcuguacaucuggggcgugcaccaccccagcaccgacaaggagcagaccgaccuguacgugcaggccagcggcaaggugaccgugagcaccaagagaagccagcagaccgugauccccaacgugggcagcagacccugggugagaggccugagcagcagagugagcaucuacuggaccaucgugaagcccggcgacauccuggugaucaacagcaacggcaaccugaucgcccccagaggcuacuucaagaugagaaccggcaagagcagcaucaugagaagcgacgcccccaucggcaccugcagcagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggcaucuucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161070 - RNA, 1701 nt, Artificial Sequence
  derived and/or modified sequence opt4 from hemagglutinin__InfluenzaA__AFG99039
augaagaccaucaucgcccugagcuacaucuucugccugguguucgcccaggaccugcccggcaacgacaacagcaccgccacccugugccugggccaccacgccgugcccaacggcacccuggugaagaccaucaccaacgaccagaucgaggugaccaacgccaccgagcuggugcagagcagcagcaccggcaagaucugcgacaacccccacagaauccuggacggcaucaacugcacccugaucgacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucaucaacgagggcuucaacuggaccggcgugacccagaacggcggcagcagcgccugcaagagaggccccgacaacggcuucuucagcagacugaacuggcuguacaagagcggcagcaccuaccccgugcagaacguggccaugcccaacaacgacaacagcgacaagcuguacaucuggggcgugcaccaccccagcaccgacaaggagcagaccgaccuguacgugcaggccagcggcaaggugaccgugagcaccaagagaagccagcagaccgugauccccaacgugggcagcagacccugggugagaggccugagcagcagagugagcaucuacuggaccaucgugaagcccggcgacauccuggugaucaacagcaacggcaaccugaucgcccccagaggcuacuucaagaugagaaccggcaagagcagcaucaugagaagcgacgcccccaucggcaccugcagcagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggcaucuucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161071 - RNA, 1701 nt, Artificial Sequence; identical to SEQ ID NO: 153284
  derived and/or modified sequence opt4 from hemagglutinin__InfluenzaA__AFG99050

SEQ ID NO: 161072 - RNA, 1701 nt, Artificial Sequence
  derived and/or modified sequence opt4 from hemagglutinin__InfluenzaA__AFG99061
augaagaccaucaucgcccugagcuacaucuucugccugguguucgcccaggaccugcccggcaacgacaacagcaccgccacccugugccugggccaccacgccgugcccaacggcacccuggugaagaccaucaccaacgaccagaucgaggugaccaacgccaccgagcuggugcagagcagcagcaccggcaagaucugcgacaacccccacagaauccuggacggcaucaacugcacccugaucgacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucaucaacgagggcuucaacuggaccggcgugacccagaacggcggcagcagcgccugcaagagaggccccgacaacggcuucuucagcagacugaacuggcuguacaagagcggcagcaccuaccccgugcagaacgugaccaugcccaacaacgacaacagcgacaagcuguacaucuggggcgugcaccaccccagcaccgacaaggagcagaccgaccuguacgugcaggccagcggcaaggugaccgugagcaccaagagaagccagcagaccgugauccccaacgugggcagcagacccugggugagaggccugagcagcagagugagcaucuacuggaccaucgugaagcccggcgacauccuggugaucaacagcaacggcaaccugaucgcccccagaggcuacuucaagaugagaaccggcaagagcagcaucaugagaagcgacgcccccaucggcaccugcagcagcgagugcaucacccccaacggcagcauccccaacgacaagcccuuccagaacgugaacaagaucaccuacggcgccugccccaaguacaucaagcagaacacccugaagcuggccaccggcaugagaaacgugcccgagaagcagaccagaggcaucuucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacaaggugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161073 - RNA, 1701 nt, Artificial Sequence
  derived and/or modified sequence opt4 from hemagglutinin__InfluenzaA__AFG99072
augaagaccaucaucgcccugagcuacaucuucugccugguguucgcccaggaccugcccggcaacgacaacagcaccgccacccugugccugggccaccacgccgugcccaacggcacccuggugaagaccaucaccaacgaccagaucgaggugaccaacgccaccgagcuggugcagagcagcagcaccggcaagaucugcgacaacccccacagaauccuggacggcaagaacugcacccugaucgacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucaucaacgagggcuucaacuggaccggcgugacccagaacggcggcagcagcgccugcaagagaggccccgacaacggcuucuucagcagacugaacuggcuguacaagagcggcagcaccuaccccgugcagaacgugaccaugcccaacaacgacaacagcgacagacuguacaucuggggcgugcaccaccccagcaccgacaaggagcagaccgaccuguacgugcaggccagcggcaaggugaccgugagcaccaagagaagccagcagaccgugauccccaacgugggcagcagacccugggugagaggccugagcagcagagugagcaucuacuggaccaucgugaagcccggcgacauccuggugaucaacagcaacggcaaccugaucgcccccagaggcuacuucaagaugagaaccggcaagagcagcaucaugagaagcgacgcccccaucggcaccugcagcagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggcaucuucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161074 - RNA, 1701 nt, Artificial Sequence
  derived and/or modified sequence opt4 from hemagglutinin__InfluenzaA__AFG99083
augaagaccaucaucgcccugagcuacaucuucugccugguguucgcccaggaccugcccggcaacgacaacagcaccgccacccugugccugggccaccacgccgugcccaacggcacccuggugaagaccaucaccaacgaccagaucgaggugaccaacgccaccgagcuggugcagagcagcagcaccggcaagaucugcgacaacccccacagaauccuggacggcaucaacugcacccugaucgacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucaucaacgagggcuucaacuggaccggcgugacccagaacggcggcagcagcgccugcaagagaggccccgacaagggcuucuucagcagacugaacuggcuguacaagagcggcagcaccuaccccgugcagaacgugaccaugcccaacaacgacaacagcgacaagcuguacaucuggggcgugcaccaccccagcaccgacaaggagcagaccgaccuguacgugcaggccagcggcaaggugaccgugagcaccaagagaagccagcagaccgugauccccaacgugggcagcagacccugggugagaggccugagcagcagagugagcaucuacuggaccaucgugaagcccggcgacauccuggugaucaacagcaacggcaaccugaucgcccccagaggcuacuucaagaugcugaccggcaagagcagcaucaugagaagcgacgcccccaucggcaccugcagcagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggcaucuucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccacgaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161075 - RNA, 1701 nt, Artificial Sequence
  derived and/or modified sequence opt4 from hemagglutinin__InfluenzaA__AFG99094
augaagaccaucaucgcccugagcuacaucuucugccugguguucgcccaggaccugcccggcaacgacaacagcaccgccacccugugccugggccaccacgccgugcccaacggcacccuggugaagaccaucaccaacgaccagaucgaggugaccaacgccaccgagcuggugcagagcagcagcaccggcaagaucugcgacaacccccacagaauccuggacggcaucaacugcacccugaucgacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucaucaacgagggcuucaacuggaccggcgugacccagaacggcggcagcggcgccugcaagagaggccccgacaacggcuucuucagcagacugaacuggcuguacaagagcggcagcaccuaccccgugcagaacgugaccaugcccaacaacgacaacagcgacaagcuguacaucuggggcgugcaccaccccagcaccgacaaggagcagaccgaccuguacgugcaggccagcggcaaggugaccgugagcaccaagagaagccagcagaccgugauccccaacgugggcagcagacccugggugagaggccugagcagcagagugagcaucuacuggaccaucgugaagcccggcgacauccuggugaucaacagcaacggcaaccugaucgcccccagaggcuacuucaagaugagaaccggcaagagcagcaucaugagaagcgacgcccccaucggcaccugcagcagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggcaucuucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161076 - RNA, 1701 nt, Artificial Sequence
  derived and/or modified sequence opt4 from hemagglutinin__InfluenzaA__AFG99116
augaagaccaucaucgcccugagcuacaucuucugccugguguucgcccagaaccugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugguggacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucaucaacgagagcuucaacuggaccggcgugacccagagcggcggcagcuacgccugcaagagaggcagcgacaacagcuucuucagcagacugaacuggcuguacgagagcgagagcaaguaccccgugcugaacgugaccaugcccaacaacggcaacuucgacaagcuguacaucuggggcgugcaccaccccagcaccgacaaggagcagaccaaccuguacgugagagccagcggcagagugaccgugagcaccaagagaagccagcagaccaucauccccaacaucggcagcagacccugggugagaggccugagcagcagaaucagcaucuacuggaccaucgugaagcccggcgacauccugcugaucaacagcaacggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161077 - RNA, 1701 nt, Artificial Sequence
  derived and/or modified sequence opt4 from hemagglutinin__InfluenzaA__AFG99127
augaagaccaucaucgcccugagcuacauccugugccugguguucgcccagaaccugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugguggacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucaucaacgagagcuucaacuggaccggcgugacccagagcggcggcagcuacgccugcaagagaggcagcgacaacagcuucuucagcagacugaacuggcuguacgagagcgagagcaaguaccccgugcugaacgugaccaugcccaacaacggcaacuucgacaagcuguacaucuggggcgugcaccaccccagcaccgacaaggagcagaccaaccuguacgugagagccagcggcagagugaccgugagcaccaagagaagccagcagaccaucauccccaacaucggcagcagacccugggugagaggccugagcagcagaaucagcaucuacuggaccaucgugaagcccggcgacauccugcugaucaacagcaacggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161078 - RNA, 1701 nt, Artificial Sequence
  derived and/or modified sequence opt4 from hemagglutinin__InfluenzaA__AFG99138
augaagaccaucaucgcccugagcuacaucuucugccugguguucgcccagaaccugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugguggacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucaucaacgagagcuucaacuggaccggcgugacccagagcggcggcagcagcgccugcaagagaggcagcgacaacagcuucuucagcagacugaacuggcuguacgagagcgagagcaaguaccccgugcugaacgugaccaugcccaacaacggcaacuucgacaagcuguacaucuggggcgugcaccaccccagcaccgacaaggagcagaccaaccuguacgugagagccagcggcagagugaccgugagcaccaagagaaaccagcagaccgugauccccaacaucggcagcagacccugggugagaggccugagcagcagaaucagcaucuacuggaccaucgugaagcccggcgacauccugcugaucaacagcaacggcaaccugaucgcccccagaggcuacuucaagaucagaaacggcaagagcagcaucaugagaagcgacgcccccaucggcaccugcagcagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggcaucuucggcgccaucgccggcuucaucgagaacggcugggagggcaugguggacggcugguacggcuucagacacagaaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161079 - RNA, 1701 nt, Artificial Sequence
  derived and/or modified sequence opt4 from hemagglutinin__InfluenzaA__AFG99149
augaagaccaucaucgcccugagcuacauccugugccugguguucgcccagaaccugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacgagaagugggaccuguucguggagagaagcagagccuucagcaacugcuaccccuacgacgugcccgacuacgccagccugagaagccugguggccagcagcggcacccuggaguucaucaacgagggcuucaacuggaccggcgugacccagagcggcggcagcuacgccugcaagagaggcagcgacaacagcuucuucagcagacugaacuggcuguacgagagcgagagcaaguaccccgugcugaacgugaccaugcccaacaacggcaaguucgacaagcuguacaucuggggcgugcaccaccccagcaccgacaaggagcagaccaaccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacaagaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacgccgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161080 - RNA, 1701 nt, Artificial Sequence
  derived and/or modified sequence opt4 from hemagglutinin__InfluenzaA__AFG99171
augaagaccaucaucgcccugagcuacaucuucugccugguguucgcccagaaccugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugguggacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucaccaacgagagcuucaacuggaccggcgugacccagagcggcggcagcuacgccugcaagagaggcagcgacaacagcuucuucagcagacugaacuggcuguacgagagcgagagcaaguaccccgugcugaacgugaccaugcccaacaacggcaacuucgacaagcuguacaucuggggcgugcaccaccccagcaccgacaaggagcagaccaaccuguacgugagagccagcggcagagugaccgugagcaccaagagaaaccagcagaccgugauccccaacaucggcagcagacccugggugagaggccugagcagcagaaucagcaucuacuggaccaucgugaagcccggcgacauccugcugaucaacagcaacggcaaccugaucgcccccagaggcuacuucaagaucagaaacggcaagagcagcaucaugagaagcgacgcccccaucggcaccugcagcagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggcaucuucggcgccaucgccggcuucaucgagaacggcugggagggcaugguggacggcugguacggcuucagacacagaaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161081 - RNA, 1701 nt, Artificial Sequence
  derived and/or modified sequence opt4 from hemagglutinin__InfluenzaA__AFG99182
augaagaccaucaucgcccugagcuacaucuucugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucaucaacgagggcuucaacuggaccggcgugacccagagcggcggcagcuacgccugcaagagaggcagcgugaacagcuucuucagcagacugaacuggcuguacgagagcgaguacaaguaccccgcccugaacgugaccaugcccaacaacggcaaguucgacaagcuguacaucuggggcgugcaccaccccagcaccgacaaggagcagaccaaccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacaagaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161082 - RNA, 1701 nt, Artificial Sequence
  derived and/or modified sequence opt4 from hemagglutinin__InfluenzaA__AFG99193
augaagaccaucaucgcccugagcuacaucagcugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucaucaacgagggcuucaacuggaccggcgugacccagagcggcggcagcuacgccugcaagagaggcagcgugaacagcuucuucagcagacugaacuggcuguacgagagcgagagcaaguaccccgcccugaacgugaccaugcccaacaacggcaaguucgagaagcuguacaucuggggcgugcaccaccccagcaccgacaaggagcagaccaaccuguacgugagagccagcggcagagugaccgugagcaccaagagaagccagcagaccgugauccccaacaucggccccagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacaagaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgacaugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161083 - RNA, 1701 nt, Artificial Sequence
  derived and/or modified sequence opt4 from hemagglutinin__InfluenzaA__AFG99204
augaagaccaucaucgcccugagcuacaucuucugccugggcuucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucaucaacgagggcuucaacuggaccggcgugacccagagcggcggcagcuacgccugcaagagaggcagcgugaacagcuucuucagcagacugaacuggcuguacaagagcgagagcaaguaccccgcccugaacgugaccaugcccaacaacggcaaguucgacaagcuguacaucuggggcgugcaccaccccagcaccgacaaggagcagaccaaccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaucagaagcgacgcccccaucggcaccugcagcagcgagugcaucacccccaacggcagcauccccaacgacaagcccuuccagaacgugaacaagaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161084 - RNA, 1701 nt, Artificial Sequence
  derived and/or modified sequence opt4 from hemagglutinin__InfluenzaA__AFG99215
augaagaccaucaucgcccugagcuacaucuucugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacgagaagugggaccuguucaucgagagaagcaaggccuucagcaacugcuaccccuacgacgugcccgacuacgccagccugagaagccugguggccagcagcggcacccuggaguucaucaacgagggcuucaacuggaccggcgugacccagagcggcggcagcuacgccugcaagagaggcagcgugaacagcuucuucagcagacugaacuggcuguacgagagcgaguacaaguaccccgcccugaacgugaccaugcccaacaacggcaaguucgacaagcuguacaucuggggcgugcaccaccccagcaccgagaaggagcagaccaaccuguacgugagagccagcggcagagugaccgugagcaccaagagaagccagcagaccgugacccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacaagaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161085 - RNA, 1701 nt, Artificial Sequence
  derived and/or modified sequence opt4 from hemagglutinin__InfluenzaA__AFG99226
augaagaccaucaucgcccugagcuacaucuucugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucaucaacgagggcuucaacuggaccggcgugacccagagcggcggcagcuacgccugcaagagaggcagcgugaacagcuucuucagcagacugaacuggcuguacgagagcgaguacaaguaccccgcccugaacgugaccaugcccaacaacggcaaguucgacaagcuguacaucuggggcgugcaccaccccagcaccgacaaggagcagaccaaccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugagcaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacaagaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161086 - RNA, 1701 nt, Artificial Sequence
  derived and/or modified sequence opt4 from hemagglutinin__InfluenzaA__AFG99237
augaagaccaucaucgcccugagcuacaucuucugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucaucaacgaggacuucaacuggaccggcgugacccagagcggcggcagcuacgccugcaagagagagagcgugaacagcuucuucagcagacugaacuggcuguacgagagcgaguacaaguaccccgcccugaacgugaccaugcccaacaacggcaaguucgagaagcuguacaucuggggcgugcaccaccccagcaccgacaaggagcagaccaaccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacaagaucaccuacggcgccugccccagauacgugagacagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161087 - RNA, 1701 nt, Artificial Sequence
  derived and/or modified sequence opt4 from hemagglutinin__InfluenzaA__AFG99248
augaagaccaucaucgcccugagcuacaucuucugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacgagaagugggaccuguucguggagagaagcaaggccuacagcaacugcuaccccuacgacgugcccgacuacgccagccugagaagccugguggccagcagcggcacccuggaguucaucaacgaggacuucaacuggaccggcgugacccagagcggcggcagccacgccugcaagagaggcagcgugaacagcuucuucagcagacugaacuggcugcacgagagcgaguacaaguaccccgcccugaacgugaccaugcccaacaacggcaaguucgacaagcuguacaucuggggcgugcaccaccccaucaccgacagagagcagaccaaccuguacgugagagccagcggcagagugaccgugagcaccaagagaagccagcagaccgugauccccaacaucggcuucagacccugggugagaggccugagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaccugcagcagcgagugcaucacccccaacggcagcauccccaacgacaagcccuuccagaacgugaacaagaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161088 - RNA, 1701 nt, Artificial Sequence
  derived and/or modified sequence opt4 from hemagglutinin__InfluenzaA__AFG99259
augaagaccaucaucgcccugagcuacaucuucugccugguguucgcccagaagcugcccggcaacgacaacagcaccgccacccugugccugggccaccacgccgugcccaacggcacccuggugaagaccaucaccaacgaccagguggaggugaccaacgccaccgagcuggugcagagcagcagcaccggcagaaucugcgacagcccccacagaauccuggacggcaagaacugcacccugaucgacgcccugcugggcgacccccacugcgacggcuuccagaacgagaagugggaccuguucguggagagaagcaaggccuacagcaacugcuaccccuacgacgugcccgacuacgccagccugagaagccugguggccagcagcggcacccuggaguucaucaacgaggacuucaacuggaccggcgugacccagagcggcggcagcuacgccugcaagagaggcagcgugaacagcuucuucagcagacugaacuggcugcacaagagcgaguacaaguaccccgcccugaacgugaccaugcccaacaacggcaaguucgacaagcuguacaucuggggcgugcaccaccccagcaccgacagagagcagaccaaccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacaagaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161089 - RNA, 1701 nt, Artificial Sequence
  derived and/or modified sequence opt4 from hemagglutinin__InfluenzaA__AFG99270
augaagaccaucaucgcccugagcuacaucuucugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccagagcggcggcagcuacgccugcaagagaggcagcgugaacagcuucuucagcagacugaacuggcugcacaagagcgaguacaaguaccccgcccugaacgugaccaugcccaacaacggcaaguucgacaagcuguacaucuggggcgugcaccaccccagcaccgacagagagcagaccaaccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccacaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161090 - RNA, 1701 nt, Artificial Sequence
  derived and/or modified sequence opt4 from hemagglutinin__InfluenzaA__AFG99281
augaagaccaucaucgcccugagcuacaucuucugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucaucaacgaggaguucaacuggaccggcgugacccagagcggcggcagcuacgccugcaagagaggcagcgugaacagcuucuucagcagacugaacuggcugcacaagagcgaguacaaguaccccgcccugaacgugaccaugcccaacaacggcagauucgacaagcuguacaucuggggcgugcaccaccccagcaccgacagagagcagaccaaccuguacgugagagccagcggcagagugaccgugagcaccaagagaagccagcagaccgugauccccaacaucggccccagacccugggugagaggccugagcagcagaaucagcaucuacuggaccaucgugaagcccggcgacauccugcugaucaacagcaccggcaaccugaucgcccccagaggcuacuucaagauccacaccggcaagagcagcaucaugagaagcgacgcccccaucggcaccugcagcagcgagugcaucacccccaacggcagcauccccaacgacaagcccuuccagaacgugaacaagaucaccuacggcgccugccccagauacgugaagcagaacacccugaagcuggccaccggcaugagaaacgugcccgacaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161091 - RNA, 1701 nt, Artificial Sequence
  derived and/or modified sequence opt4 from hemagglutinin__InfluenzaA__AFG99292
augaagaccaucaucgcccugagcuacaucuucugccugguguucgcccagaagcugcccggcaacgacaacagcaccgccacccugugccugggccaccacgccgugcccaacggcacccuggugaagaccaucaccaacgaccagguggaggugaccaacgccaccgagcuggugcagagcagcagcaccggcagaaucugcgacagcccccacagaauccuggacggcaagaacugcacccugaucgacgcccugcugggcgacccccacugcgacggcuuccagaacgagaagugggaccuguucguggagagaagcaaggccuacagcaacugcuaccccuacgacgugcccgacuacgccagccugagaagccugguggccagcagcggcacccuggaguucaucaacgaggacuucaacuggaccggcgugacccagagcggcggcagcuacgccugcaagagaggcagcgugaacagcuucuucagcagacugaacuggcugcacgagagcgaguacaaguaccccgcccugaacgugaccaugcccaacaacggcaaguucgacaagcuguacaucuggggcgugcaccaccccagcaccgacagagagcagaccaaccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacaagaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161092 - RNA, 1701 nt, Artificial Sequence
  derived and/or modified sequence opt4 from hemagglutinin__InfluenzaA__AFG99303
augaagaccaucaucgcccugagcuacaucuucugccuggugguggcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccagagcggcggcagcuacgccugcaagagaggcagcgugaacagcuucuucagcagacugaacuggcugcacgagagcgaguacaaguaccccgcccugaacgugaccaugcccaacaacggcaaguucgacaagcuguacaucuggggcgugcaccaccccagcaccgacagagagcagaccaaccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcaucagcaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161093 - RNA, 1701 nt, Artificial Sequence
  derived and/or modified sequence opt4 from hemagglutinin__InfluenzaA__AFG99314
augaagaccaucaucgcccugagcuacaucuucugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacagcuuccagaacgagaagugggaccuguucguggagagaagcaaggccuacagcaacugcuaccccuacgacgugcccgacuacgccagccugagaagccugguggccagcagcggcacccuggaguucaucaacgaggacuucaacuggaccggcgugacccagagcggcggcagcuacgccugcaagagaggcagcgugaacagcuucuucagcagacugaacuggcugcacgagagcgaguacaaguaccccgcccugaacgugaccaugcccaacaacggcaaguucgacaagcuguacaucuggggcauccaccaccccagcaccgacagagagcagaccaaccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagcugagaaccggcaagagcagcaucaugagaagcgacgcccccaucggcaccugcagcagcgagugcaucacccccaacggcagcauccccaacgacaagcccuuccagaacgugaacaagaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161094 - RNA, 1701 nt, Artificial Sequence
  derived and/or modified sequence opt4 from hemagglutinin__InfluenzaA__AFG99336
augaagaccaucaucgcccugagcuacaucuucugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccagagcggcggcagcuacgccugcaagagaggcagcgugaacagcuucuucagcagacugaacuggcugcacaagagcgaguacaaguaccccgcccugaacgugaccaugcccaacaacggcaaguucgacaagcuguacaucuggggcgugcaccaccccagcaccgacagagagcagaccaaccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161095 - RNA, 1701 nt, Artificial Sequence
  derived and/or modified sequence opt4 from hemagglutinin__InfluenzaA__AFG99347
augaagaccaucaucgcccugagcuacaucuucugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccagagcggcggcagcuacgccugcaagagaggcagcgugaacagcuucuucagcagacugaacuggcugcacaagcccgaguacaaguaccccgcccugaacgugaccaugcccaacaacggcaaguucgacaagcuguacaucuggggcgugcaccaccccagcaccgacagagagcagaccaaccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgacaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161096 - RNA, 1701 nt, Artificial Sequence
  derived and/or modified sequence opt4 from hemagglutinin__InfluenzaA__AFG99358
augaagaccaucaucgcccugagccacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcggcagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcagagugaccgugagcaccaagagaagccagcagaccgugacccccaacaucggcagcagacccugggugagaggccugagcagcagaaucagcaucuacuggaccaucgugaagcccggcgacauccugcugaucaacagcaucggcaaccugaucgcccccagaggcuacuucaagaucagaaacggcaagagcagcaucaugagaagcgacgugcccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161097 - RNA, 1701 nt, Artificial Sequence
  derived and/or modified sequence opt4 from hemagglutinin__InfluenzaA__AFG99369
augaagaccaucaucgcccugagcuacaucuucugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacugggccggcguggcccagagcggcggcagcuacgccugcaagagaggcagcgugaacagcuucuucagcagacugaacuggcugcacgagagcgaguacaaguaccccgcccugaacgugaccaugcccaacaacggcaaguucgacaagcuguacaucuggggcgugcaccaccccagcaccgacagagagcagaccaaccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaccagcugcuuccugcugugcguggugcugcugggcuucaucaugugggccugccagaagggcaacaucagaugcaacaucugcaucuga

SEQ ID NO: 161098 - RNA, 1701 nt, Artificial Sequence
  derived and/or modified sequence opt4 from hemagglutinin__InfluenzaA__AFG99380
augaagaccaucaucgcccugagcuacaucuucugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccagagcggcggcagcuacgccugcaagagaggcagcgugaacagcuucuucagcagacugaacuggcugcacgagagcgaguacaaguaccccgcccugaacgugaccaugcccaacaacggcaaguucgacaagcuguacaucuggggcgugcaccaccccagcaccgacagagagcagaccaaccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161099 - RNA, 1701 nt, Artificial Sequence; identical to SEQ ID NO: 161098
  derived and/or modified sequence opt4 from hemagglutinin__InfluenzaA__AFG99391

SEQ ID NO: 161100 - RNA, 1701 nt, Artificial Sequence
  derived and/or modified sequence opt4 from hemagglutinin__InfluenzaA__AFG99402
augaagaccaucaucgcccugagcuacaucuucugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacgagaagugggaccuguucguggagagaagcaaggccuacagcaacugcuaccccuacgacgugcccgacuacgccagccugagaagccugguggccagcagcggcacccuggaguucaucaacgaggacuucaacuggaccggcgugacccagagcggcggcagcuacgccugcaagagaggcagcgugaacagcuucuucagcagacugaacuggcugcacaagagcgaguacaaguaccccgcccugaacgugaccaugcccaacaacggcaaguucgacaagcuguacaucuggggcgugcaccaccccgugaccgacagagagcagaccaaccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacaagaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161101 - RNA, 1701 nt, Artificial Sequence
  derived and/or modified sequence opt4 from hemagglutinin__InfluenzaA__AFG99413
augaagaccaucaucgcccugagcuacaucuucugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccagagcggcggcagcuacgccugcaagagaggcagcgugaacagcuucuucagcagacugaacuggcugcacgagagcgaguacaaguaccccgcccugaacgugaccaugcccaacaacggcaaguucgacaagcuguacaucuggggcgugcaccaccccagcaccgacagagagcagaccaaccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161102 - RNA, 1701 nt, Artificial Sequence
  derived and/or modified sequence opt4 from hemagglutinin__InfluenzaA__AFG99424
augaagaccaucaucgcccugagcuacaucuucugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccagagcggcggcagcuacgccugcaagagaggcagcgugaacagcuucuucagcagacugaacuggcugcacaagagcgaguacaaguaccccgcccugaacgugaccaugcccaacaacggcaaguucgacaagcuguacaucuggggcgugcaccaccccagcaccgacagagagcagaccaaccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161103 - RNA, 1701 nt, Artificial Sequence
  derived and/or modified sequence opt4 from hemagglutinin__InfluenzaA__AFG99435
augaagaccaucaucgcccugagcuacaucuucugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagaacagcagcaccggcagaaucugcgacagcccccacagaauccuggacggcaagaacugcacccugaucgacgcccugcugggcgacccccacugcgacggccugcagaacaaggagugggaccuguucguggagagaagcaaggccuacagcaacugcuaccccuacgacgugcccgacuacgccagccugagaagccugguggccagcagcggcacccuggaguucaccaaggaggacuucaacuggaccggcguggcccagagcggcggcagcuacgccugcaagagaggcagcgugaacagcuucuucagcagacugaacuggcugcacgagagcgaguacaaguaccccgcccugaacgugaccaugcccaacaacggcaaguucgacaagcuguacaucuggggcgugcaccaccccagcaccgacagagagcagaccaaccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161104 - RNA, 1701 nt, Artificial Sequence; identical to SEQ ID NO: 161103
  derived and/or modified sequence opt4 from hemagglutinin__InfluenzaA__AFG99446

SEQ ID NO: 161105 - RNA, 1701 nt, Artificial Sequence
  derived and/or modified sequence opt4 from hemagglutinin__InfluenzaA__AFG99457
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccagagcggcggcagcuacgccugcaagagaggcagcgugaacagcuucuucagcagacugaacuggcugcacaagagcgaguacaaguaccccgcccugaacgugaccaugcccaacaacggcaaguucgacaagcuguacaucuggggcgugcaccaccccagcaccgacagagaccagaccagccuguacgugagagccagcggcagagugaccgugagcaccaagagaagccagcagaccgugauccccaacaucggcagcagacccugggugagaggccagagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaccugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161106 - RNA, 1701 nt, Artificial Sequence
  derived and/or modified sequence opt4 from hemagglutinin__InfluenzaA__AFG99468
augaagaccaucaucgcccugagcuacaucuucugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccagagcggcggcagcuacgccugcaagagaggcagcgugaacagcuucuucagcagacugaacuggcugcacgagagcgaguacaaguaccccgcccugaacgugaccaugcccaacaacggcaaguucgacaagcuguacaucuggggcgugcaccaccccagcaccgacagagagcagaccaaccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagauggacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161107 - RNA, 1701 nt, Artificial Sequence
  derived and/or modified sequence opt4 from hemagglutinin__InfluenzaA__AFG99490
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucaucgagagaagcaaggccuacagcaacugcuaccccuacgacgugcccgacuacgccagccugagaagccugguggccagcagcggcacccuggaguucaucaacgaggacuucaacuggaccggcguggcccagagcggcgagagcuacgccugcaagagaggcagcgugaagagcuucuucagcagacugaacuggcugcacgagagcgaguacaaguaccccgcccugaacgugaccaugcccaacaacggcaaguucgacaagcuguacaucuggggcgugcaccaccccagcaccgacagagagcagaccagccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161108 - RNA, 1701 nt, Artificial Sequence
  derived and/or modified sequence opt4 from hemagglutinin__InfluenzaA__AFG99501
augaagaccaucaucgcccugagcuacaucuucugccuggugguggcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccagagcggcggcagcuacaccugcaagagaggcagcgugaacagcuucuucagcagacugaacuggcugcacgagagcgaguacaaguaccccgcccugaacgugaccaugcccaacaacggcaaguucgacaagcuguacaucuggggcgugcaccaccccagcaccgacagagagcagaccaaccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcaucagcaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161109 - RNA, 1701 nt, Artificial Sequence
  derived and/or modified sequence opt4 from hemagglutinin__InfluenzaA__AFG99512
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccagagcggcgacagcuacgccugcaagagaggcagcgugaagagcuucuucagcagacugaacuggcugcacgagagcgaguacaaguaccccgcccugaacgugaccaugcccaacaacgacaaguucgacaagcuguacaucuggggcgugcaccaccccagcaccgacagagagcagaccagccuguacaucagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161110 - RNA, 1701 nt, Artificial Sequence
  derived and/or modified sequence opt4 from hemagglutinin__InfluenzaA__AFG99523
augaagaccaucaucgcccugagcuacaucuucugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccagagcggcggcagcuacgccugcaagagaggcagcgugaacagcuucuucagcagacugaacuggcugcacgagagccaguacaaguaccccgcccugaacgugaccaugcccaacaacggcaaguucgacaagcuguacaucuggggcgugcaccaccccagcaccgacagagagcagaccaaccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161111 - RNA, 1701 nt, Artificial Sequence; identical to SEQ ID NO: 161007
  derived and/or modified sequence opt4 from hemagglutinin__InfluenzaA__AFG99534

SEQ ID NO: 161112 - RNA, 1701 nt, Artificial Sequence; identical to SEQ ID NO: 161007
  derived and/or modified sequence opt4 from hemagglutinin__InfluenzaA__AFG99545

SEQ ID NO: 161113 - RNA, 1701 nt, Artificial Sequence
  derived and/or modified sequence opt4 from hemagglutinin__InfluenzaA__AFG99556
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaccaacgaggacuucaacuggaccggcguggcccagagcggcgagagcuacgccugcaagagaggcagcgugaagagcuucuucagcagacugaacuggcugcacgagagcgacuacaaguaccccgcccugaacgugaccaugcccaacaacggcaaguucgacaagcuguacaucuggggcgugcaccaccccagcaccgacagagagcagaccagccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgacagaaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161114 - RNA, 1701 nt, Artificial Sequence; identical to SEQ ID NO: 161007
  derived and/or modified sequence opt4 from hemagglutinin__InfluenzaA__AFG99567

SEQ ID NO: 161115 - RNA, 1701 nt, Artificial Sequence; identical to SEQ ID NO: 161007
  derived and/or modified sequence opt4 from hemagglutinin__InfluenzaA__AFG99578

SEQ ID NO: 161116 - RNA, 1701 nt, Artificial Sequence; identical to SEQ ID NO: 161007
  derived and/or modified sequence opt4 from hemagglutinin__InfluenzaA__AFG99589

SEQ ID NO: 161117 - RNA, 1701 nt, Artificial Sequence
  derived and/or modified sequence opt4 from hemagglutinin__InfluenzaA__AFG99600
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagagugcuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaccaacgaggacuucaacuggaccggcguggcccagagcggcgagagcuacgccugcaagagaggcagcgugaagagcuucuucagcagacugaacuggcugcacgagagcgacuacaaguaccccgcccugaacgugaccaugcccaacaacggcaaguucgacaagcuguacaucuggggcgugcaccaccccagcaccgacagagagcagaccagccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaucggcaagagcagcaucaugagaagcgacgcccccaucggcaccugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161118 - RNA, 1701 nt, Artificial Sequence; identical to SEQ ID NO: 161007
  derived and/or modified sequence opt4 from hemagglutinin__InfluenzaA__AFG99611

SEQ ID NO: 161119 - RNA, 1701 nt, Artificial Sequence; identical to SEQ ID NO: 161007
  derived and/or modified sequence opt4 from hemagglutinin__InfluenzaA__AFG99622

SEQ ID NO: 161120 - RNA, 1701 nt, Artificial Sequence; identical to SEQ ID NO: 161007
  derived and/or modified sequence opt4 from hemagglutinin__InfluenzaA__AFG99633

SEQ ID NO: 161121 - RNA, 1701 nt, Artificial Sequence
  derived and/or modified sequence opt4 from hemagglutinin__InfluenzaA__AFG99644
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagaacagcagcaccggcagaaucugcgacagcccccacagaauccuggacggcaagaacugcacccugaucgacgcccugcugggcgacccccacugcgacgacuuccagaacaaggagugggaccuguucguggagagaagcaaggccuacagcaacugcuaccccuacgacgugcccgacuacgccagccugagaagccugguggccgccagcggcacccuggaguucaucaacgaggacuucaacuggaccggcguggcccagagcggcgagagcuacgccugcaagagaggcagcgugaagagcuucuucagcagacugaacuggcugcacgagagcgaguacaaguaccccgcccugaacgugaccaugcccaacaacggcaaguucgacaagcuguacaucuggggcgugcaccaccccagcaccgacagagagcagaccagccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagaucgagggcagaauccagaaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161122 - RNA, 1701 nt, Artificial Sequence
  derived and/or modified sequence opt4 from hemagglutinin__InfluenzaA__AFG99655
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagaacagcagcaccggcagaaucugcgacagcccccacagaauccuggacggcaagaacugcacccugaucgacgcccugcugggcgacccccacugcgacgacuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccagagcggcgagagcuacgccugcaagagaggcagcgugaagagcuucuucagcagacugaacuggcugcacgagagcgaguacaaguaccccgcccugaacgugaccaugcccaacaacggcaaguucgacaagcuguacaucuggggcgugcaccaccccagcaccgacagagagcagaccagccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagaucgagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161123 - RNA, 1701 nt, Artificial Sequence; identical to SEQ ID NO: 161122
  derived and/or modified sequence opt4 from hemagglutinin__InfluenzaA__AFG99666

SEQ ID NO: 161124 - RNA, 1701 nt, Artificial Sequence; identical to SEQ ID NO: 154858
  derived and/or modified sequence opt4 from hemagglutinin__InfluenzaA__AFG99677

SEQ ID NO: 161125 - RNA, 1701 nt, Artificial Sequence; identical to SEQ ID NO: 161007
  derived and/or modified sequence opt4 from hemagglutinin__InfluenzaA__AFG99688

SEQ ID NO: 161126 - RNA, 1701 nt, Artificial Sequence
  derived and/or modified sequence opt4 from hemagglutinin__InfluenzaA__AFG99701
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaacgccuacagcaacugcuaccccuacgacgugcccgacuacgccagccugagaagccugguggccagcagcggcacccuggaguucaccaacgaggacuucaacuggaccggcguggcccagagcggcgagagcuacgccugcaagagaggcagcgugaagagcuucuucagcagacugaacuggcugcacgagagcgacuacaaguaccccgcccugaacgugaccaugcccaacaacggcaaguucgacaagcuguacaucuggggcgugcaccaccccagcaccgacagagagcagaccagccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcgccgagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161127 - RNA, 1701 nt, Artificial Sequence
  derived and/or modified sequence opt4 from hemagglutinin__InfluenzaA__AFG99712
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgaggugcccgacuacgccagccugagaagccugguggccagcagcggcacccuggaguucaccaacgaggacuucaacuggaccggcguggcccagagcggcgagagcuacgccugcaagagaggcagcgugaagagcuucuucagcagacugaacuggcugcacgagagcgacuacaaguaccccgcccugaacgugaccaugcccaacaacggcaaguucgacaagcuguacaucuggggcgugcaccaccccagcaccgacagagagcagaccagccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161128 - RNA, 1701 nt, Artificial Sequence; identical to SEQ ID NO: 161007
  derived and/or modified sequence opt4 from hemagglutinin__InfluenzaA__AFG99723

SEQ ID NO: 161129 - RNA, 1701 nt, Artificial Sequence; identical to SEQ ID NO: 161122
  derived and/or modified sequence opt4 from hemagglutinin__InfluenzaA__AFG99734

SEQ ID NO: 161130 - RNA, 1701 nt, Artificial Sequence
  derived and/or modified sequence opt4 from hemagglutinin__InfluenzaA__AFG99745
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccagagcggcgacagcuacgccugcaagagaggcagcgugaagagcuucuucagcagacugaacuggcugcacgagagcgaguacaaguaccccgcccugaacgugaccaugcccaacaacgacaaguucgacaagcuguacaucuggggcgugcaccaccccagcaccgagagagagcagaccagccuguacaucagagccagcggcagagugaccgugagcaccaagagaagccagcagaccgugauccccaacaucggcagcaagcccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaugggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161131 - RNA, 1701 nt, Artificial Sequence; identical to SEQ ID NO: 161007
  derived and/or modified sequence opt4 from hemagglutinin__InfluenzaA__AFG99756

SEQ ID NO: 161132 - RNA, 1701 nt, Artificial Sequence
  derived and/or modified sequence opt4 from hemagglutinin__InfluenzaA__AFG99767
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacgacuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccagagcggcgagagcuacgccugcaagagaggcagcgugaagagcuucuucagcagacugaacuggcugcacgagagcgaguacaaguaccccgcccugaacgugaccaugcccaacaacgacaaguucgacaagcuguacaucuggggcgugcaccaccccagcaccgacagagagcagaccagccuguacaucagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161133 - RNA, 1701 nt, Artificial Sequence
  derived and/or modified sequence opt4 from hemagglutinin__InfluenzaA__AFG99778
augaagaccaucaucgcccugagcuacauccugugccugguguucgcccagaagcugcccggcaacgacaacagcaccgccacccugugccugggccaccacgccgugcccaacggcacccuggugaagacccugaccaacgaccagaucgaggugaccaacgccaccgagcuggugcagagcagcagcaccggcaagaucugcgacagcccccacagaauccuggacggcaagaacugcacccugaucgacgcccugcugggcgacccccacugcgacggccugcagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcggcagcuacgccugcaagagaggcagcgugaacagcuucuucagcagacugaacuggcugcacaagagcgaguacaaguaccccgcccugaacgugaccaugcccaacaacggcaagguggacaagcuguacaucuggggcgugcaccaccccagcaccgacagagaccagaccagccuguacgugagagccagcggcagagugaccgugagcaccaagagaagccagcagaccgugauccccaacaucggcagcagacccugggugagaggccagagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaccugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161134 - RNA, 1701 nt, Artificial Sequence; identical to SEQ ID NO: 161007
  derived and/or modified sequence opt4 from hemagglutinin__InfluenzaA__AFG99789

SEQ ID NO: 161135 - RNA, 1701 nt, Artificial Sequence; identical to SEQ ID NO: 161122
  derived and/or modified sequence opt4 from hemagglutinin__InfluenzaA__AFG99800

SEQ ID NO: 161136 - RNA, 1701 nt, Artificial Sequence
  derived and/or modified sequence opt4 from hemagglutinin__InfluenzaA__AFG99811
augaagaccaucaucgcccugagcuacauccugugccugguguucagccagaagcugcccggcaacgacaacagcaccgccacccugugccugggccaccacgccgugcccaacggcacccuggugaagaccaucaccaacgaccagaucgaggugaccaacgccaccgagcuggugcagaacagcagcaccggcagaaucugcgacagcccccacagaauccuggacggcaagaacugcacccugaucgacgcccugcugggcgacccccacugcgacgacuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccagagcggcgagagcuacgccugcaagagaggcagcgugaagagcuucuucagcagacugaacuggcugcacgagagcgaguacaaguaccccgcccugaacgugaccaugcccaacaacggcaaguucgacaagcuguacaucuggggcgugcaccaccccagcaccgacagagagcagaccagccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagaucgagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161137 - RNA, 1701 nt, Artificial Sequence; identical to SEQ ID NO: 161007
  derived and/or modified sequence opt4 from hemagglutinin__InfluenzaA__AFG99822

SEQ ID NO: 161138 - RNA, 1701 nt, Artificial Sequence; identical to SEQ ID NO: 161007
  derived and/or modified sequence opt4 from hemagglutinin__InfluenzaA__AFG99833

SEQ ID NO: 161139 - RNA, 1701 nt, Artificial Sequence; identical to SEQ ID NO: 161007
  derived and/or modified sequence opt4 from hemagglutinin__InfluenzaA__AFG99844

SEQ ID NO: 161140 - RNA, 1701 nt, Artificial Sequence
  derived and/or modified sequence opt4 from hemagglutinin__InfluenzaA__AFG99855
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaccaacgaggacuucaacuggaccggcguggcccagagcggcgagagcuacgccugcaagagaggcagcgugaagagcuucuucagcagacugaacuggcugcacgagagcgacuacaaguaccccgcccugaacgugaccaugcccaacaacggcaaguucgacaagcuguacaucuggggcgugcaccaccccagcaccgacagagagcagaccagccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccggcaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161141 - RNA, 1701 nt, Artificial Sequence; identical to SEQ ID NO: 161007
  derived and/or modified sequence opt4 from hemagglutinin__InfluenzaA__AFG99866

SEQ ID NO: 161142 - RNA, 1701 nt, Artificial Sequence; identical to SEQ ID NO: 161007
  derived and/or modified sequence opt4 from hemagglutinin__InfluenzaA__AFG99877

SEQ ID NO: 161143 - RNA, 1701 nt, Artificial Sequence
  derived and/or modified sequence opt4 from hemagglutinin__InfluenzaA__AFG99888
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccagagcggcgagagcuacgccugcaagagaggcagcgugaagagcuucuucagcagacugaacuggcugcacgagagcgaguacaaguaccccgcccugaacgugaccaugcccaacaacgacaaguucgacaagcuguacaucuggggcgugcaccaccccagcaccgacagagagcagaccagccuguacaucagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161144 - RNA, 1701 nt, Artificial Sequence; identical to SEQ ID NO: 161007
  derived and/or modified sequence opt4 from hemagglutinin__InfluenzaA__AFG99899

SEQ ID NO: 161145 - RNA, 1701 nt, Artificial Sequence; identical to SEQ ID NO: 161007
  derived and/or modified sequence opt4 from hemagglutinin__InfluenzaA__AFG99910

SEQ ID NO: 161146 - RNA, 1701 nt, Artificial Sequence; identical to SEQ ID NO: 161007
  derived and/or modified sequence opt4 from hemagglutinin__InfluenzaA__AFG99921

SEQ ID NO: 161147 - RNA, 1701 nt, Artificial Sequence
  derived and/or modified sequence opt4 from hemagglutinin__InfluenzaA__AFG99932
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccagagcggcgagagcuacgccugcaagagaggcagcgugaagagcuucuucagcagacugaacuggcugcacgagagcgaguacaaguaccccgcccugaacgugaccaugcccaacaacgacaaguucgacaagcuguacaucuggggcgugcaccaccccagcaccgacagagagcagaccagccuguacaucagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161148 - RNA, 1701 nt, Artificial Sequence; identical to SEQ ID NO: 161007
  derived and/or modified sequence opt4 from hemagglutinin__InfluenzaA__AFG99943

SEQ ID NO: 161149 - RNA, 1701 nt, Artificial Sequence
  derived and/or modified sequence opt4 from hemagglutinin__InfluenzaA__AFG99954
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccagagcggcgacagcuacgccugcaagagaggcagcgugaagagcuucuucagcagacugaacuggcugcacgagagcgaguacaaguaccccgcccugaacgugaccaugcccaacaacgacaaguucgacaagcuguacaucuggggcgugcaccaccccagcaccgagagagagcagaccagccuguacaucagagccagcggcagagugaccgugagcaccaagagaagccagcagaccgugauccccaacaucggcuucaagcccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161150 - RNA, 1701 nt, Artificial Sequence
  derived and/or modified sequence opt4 from hemagglutinin__InfluenzaA__AFG99965
augaagaccaucaucgcccugagcuacauccugugccuggccuucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaccaacgaggacuucaacuggaccggcguggcccagagcggcgagagcuacgccugcaagagaggcagcgugaagagcuucuucagcagacugaacuggcugcacgagagcgacuacaaguaccccgcccugaacgugaccaugcccaacaacggcaaguucgacaagcuguacaucuggggcgugcaccaccccagcaccgacagagagcagaccagccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161151 - RNA, 1701 nt, Artificial Sequence; identical to SEQ ID NO: 161007
  derived and/or modified sequence opt4 from hemagglutinin__InfluenzaA__AFG99976

SEQ ID NO: 161152 - RNA, 1701 nt, Artificial Sequence
  derived and/or modified sequence opt4 from hemagglutinin__InfluenzaA__AFG99987
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccagaacggcgacagcuacgccugcaagagaggcagcgugaagagcuucuucagcagacugaacuggcugcacgagagcgaguacaaguaccccgcccugaacgugaccaugcccaacaacgacaaguucgacaagcuguacaucuggggcgugcaccaccccagcaccgacagagagcagaccagccuguacaucagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161153 - RNA, 1701 nt, Artificial Sequence
  derived and/or modified sequence opt4 from hemagglutinin__InfluenzaA__AFG99998
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcggcagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcagagugaccgugagcaccaagagaagccagcagaccgugacccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161154 - RNA, 1701 nt, Artificial Sequence; identical to SEQ ID NO: 161122
  derived and/or modified sequence opt4 from hemagglutinin__InfluenzaA__AFH00021

SEQ ID NO: 161155 - RNA, 1701 nt, Artificial Sequence
  derived and/or modified sequence opt4 from hemagglutinin__InfluenzaA__AFH00032
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcaagaucugcgacagcccccacagaauccuggacggcaagaacugcacccugaucgacgcccugcugggcgacccccacugcgacgacuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccagagcggcgacagcuacgccugcaagagaggcagcgugaagagcuucuucagcagacugaacuggcugcacgagagcgaguacaaguaccccgcccugaacgugaccaugcccaacaacgacaaguucgacaagcuguacaucuggggcgugcaccaccccagcaccgacagagagcagaccagccuguacaucagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacaagcugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161156 - RNA, 1701 nt, Artificial Sequence
  derived and/or modified sequence opt4 from hemagglutinin__InfluenzaA__AFH00043
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcaagaucugcgacagcccccacagaauccuggacggcaagaacugcacccugaucgacgcccugcugggcgacccccacugcgacgacuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccagagcggcgacagcuacgccugcaagagaggcagcgugaagagcuucuucagcagacugaacuggcugcacgagagcgaguacaaguaccccgcccugaacgugaccaugcccaacaacgacaaguucgacaagcuguacaucuggggcgugcaccaccccagcaccgacagagagcagaccagccuguacaucagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgccaccaucggcaccugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacaagcugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161157 - RNA, 1701 nt, Artificial Sequence
  derived and/or modified sequence opt4 from hemagglutinin__InfluenzaA__AFH00054
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccagaacggcgacagcuacgccugcaagagaggcagcgugaagagcuucuucagcagacugaacuggcugcacgagagcgaguacaaguaccccgcccugaacgugaccaugcccaacaacgacaaguucgacaagcuguacaucuggggcgugcaccaccccagcaccgacagagagcagaccagccuguacaucagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccacaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161158 - RNA, 1701 nt, Artificial Sequence
  derived and/or modified sequence opt4 from hemagglutinin__InfluenzaA__AFH00065
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcggcagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcagagugaccgugagcaccaagagaagccagcagaccgugauccccaacaucggcagcagacccugggugagaggccagcccagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161159 - RNA, 1701 nt, Artificial Sequence
  derived and/or modified sequence opt4 from hemagglutinin__InfluenzaA__AFH00076
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcaagaucugcgacagcccccacagaauccuggacggcaagaacugcacccugaucgacgcccugcugggcgacccccacugcgacgacuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccagagcggcgacagcuacgccugcaagagaggcagcgugaagagcuucuucagcagacugaacuggcugcacgagagcgaguacaaguaccccgcccugaacgugaccaugcccaacaacgacaaguucgacaagcuguacaucuggggcgugcaccaccccagcaccgacagagagcagaccagccuguacaucagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161160 - RNA, 1701 nt, Artificial Sequence
  derived and/or modified sequence opt4 from hemagglutinin__InfluenzaA__AFH00087
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcgaggccuacagcagcugcuaccccuacgacgugcccgacuacgccagccugagaagccugguggccagcagcggcacccuggaguucaucaacgaggacuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcagagugaccgugagcaccaagagaagccagcagaccgugauccccaacaucggcagcagacccugggugagaggccagagcagcagaaucggcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacaagaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161161 - RNA, 1701 nt, Artificial Sequence
  derived and/or modified sequence opt4 from hemagglutinin__InfluenzaA__AFH00098
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcggcagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcagagugaccgugagcaccaagagaagccagcagaccgugauccccaacaucggcagcagacccugggugagaggccugcccagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161162 - RNA, 1701 nt, Artificial Sequence
  derived and/or modified sequence opt4 from hemagglutinin__InfluenzaA__AFH00109
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcaagagcuacaccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcagagugaccgugagcaccaagagaagccagcagaccgugauccccaacaucggcuucagacccugggugagaggccugagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccggccugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161163 - RNA, 1701 nt, Artificial Sequence
  derived and/or modified sequence opt4 from hemagglutinin__InfluenzaA__AFH00120
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcagagugaccgugagcaccaagagaagccagcagaccgugauccccaacaucggcuucagacccugggugagaggccugagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccggccugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaccaugugggccugccagaagggcaacaucagaugcaacaucugcaucuga

SEQ ID NO: 161164 - RNA, 1701 nt, Artificial Sequence; identical to SEQ ID NO: 161018
  derived and/or modified sequence opt4 from hemagglutinin__InfluenzaA__AFH00131

SEQ ID NO: 161165 - RNA, 1701 nt, Artificial Sequence
  derived and/or modified sequence opt4 from hemagglutinin__InfluenzaA__AFH00153
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacaucagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161166 - RNA, 1701 nt, Artificial Sequence
  derived and/or modified sequence opt4 from hemagglutinin__InfluenzaA__AFH00164
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugauggacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccagaacggcgacagcuacgccugcaagagaggcagcgugaagagcuucuucagcagacugaacuggcugcacgagagcgaguacaaguaccccgcccugaacgugaccaugcccaacaacgacaaguucgacaagcuguacaucuggggcgugcaccaccccagcaccgacagagagcagaccagccuguacaucagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161167 - RNA, 1701 nt, Artificial Sequence
  derived and/or modified sequence opt4 from hemagglutinin__InfluenzaA__AFH00175
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcaagagcuacgccugcaagagaggcagcgugaagagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcagagugaccgugagcaccaagaagagccagcagaccgugauccccaacaucggcagcagacccugggugagaggccagagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161168 - RNA, 1701 nt, Artificial Sequence
  derived and/or modified sequence opt4 from hemagglutinin__InfluenzaA__AFH00186
augaagaccaucaucgcccugagccacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcggcagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcagagugaccgugagcaccaagagaagccagcagaccgugacccccaacaucggcagcagacccugggugagaggccagagcagcagaaucagcaucuacuggaccaucgugaagcccggcgacauccugcugaucagcagcaccggcaaccugaucgcccccagaggcuacuucaagaucagaaacggcaagagcagcaucaugagaagcgacgugcccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugaucguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161169 - RNA, 1701 nt, Artificial Sequence
  derived and/or modified sequence opt4 from hemagglutinin__InfluenzaA__AFH00197
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcggcagcuacaccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcagagugaccgugagcaccaagaucagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161170 - RNA, 1701 nt, Artificial Sequence
  derived and/or modified sequence opt4 from hemagglutinin__InfluenzaA__AFH00208
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccagaacggcgacagcuacgccugcaagagaggcagcgugaagagcuucuucagcagacugaacuggcugcacgagagcgaguacaaguaccccgcccugaacgugaccaugcccaacaacgacaaguucgacaagcuguacaucuggggcgugcaccaccccagcaccgacagagagcagaccagccuguacaucagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcgugaugagaagcgacgcccccaucggcaccugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugagcagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161171 - RNA, 1701 nt, Artificial Sequence
  derived and/or modified sequence opt4 from hemagglutinin__InfluenzaA__AFH00219
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgaccccaacugcgacggcuuccagaacaaggagugggaccuguucguggagagaagcaaggccuacagcaacugcuaccccuacgacgugcccgacuacgccagccugagaagccugguggccagcagcggcacccuggaguucaccaacgaggacuucaacuggaccggcguggcccaggacggcggcagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcagagugaccgugagcaccaagagaagccagcagaccgugacccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaccugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgacaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161172 - RNA, 1701 nt, Artificial Sequence
  derived and/or modified sequence opt4 from hemagglutinin__InfluenzaA__AFH00230
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcaagagcuacgccugcaagagaggcagcgugaagagcuucuucagcagacugaacuggcugcacaagcuggaguacaaguaccccgcccugaacgugaccaugcccaacaacggcaaguucgacaagcuguacaucuggggcgugcaccaccccagcaccaacagcgaccagaccagccuguacgugagagccagcggcagagugaccgugagcaccaagagaagccagcagaccgugauccccaacaucggcuucagacccugggugagaggccugagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccggccugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161173 - RNA, 1701 nt, Artificial Sequence; identical to SEQ ID NO: 153544
  derived and/or modified sequence opt4 from hemagglutinin__InfluenzaA__AFH00241

SEQ ID NO: 161174 - RNA, 1701 nt, Artificial Sequence
  derived and/or modified sequence opt4 from hemagglutinin__InfluenzaA__AFH00252
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacgacuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccagagcggcgacagcuacgccugcaagagaggcagcgugaagagcuucuucagcagacugaacuggcugcacgagagcgaguacaaguaccccgcccugaacgugaccaugcccaacaacgacaaguucgacaagcuguacaucuggggcgugcaccaccccagcaccgacagagagcagaccagccuguacaucagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161175 - RNA, 1701 nt, Artificial Sequence
  derived and/or modified sequence opt4 from hemagglutinin__InfluenzaA__AFH00263
augaagaccaucaucgcccugagcuacauccugcaccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgaccccaacugcgacggcuuccagaacaaggagugggaccuguucguggagagaagcaaggccuacagcaacugcuaccccuacgacgugcccgacuacgccagccugagaagccugguggccagcagcggcacccuggaguucaccaacgaggacuucaacuggaccggcguggcccaggacggcggcagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgugcagaccagccuguacgugagagccagcggcaaggugaccgugagcaccaagagaagccagcagaccgugacccccaacaucggcagcaagcccugggugagaggccugagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaccugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161176 - RNA, 1701 nt, Artificial Sequence
  derived and/or modified sequence opt4 from hemagglutinin__InfluenzaA__AFH00274
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcagagugaccgugagcaccaagagaagccagcagaccgugauccccaacaucggcuucagacccugggugagaggccugagcagcggcaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccggccugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161177 - RNA, 1701 nt, Artificial Sequence
  derived and/or modified sequence opt4 from hemagglutinin__InfluenzaA__AFH00285
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcggcagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcggcagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcagagugaccgugagcaccaagagaagccagcagaccgugacccccaacaucggcagcagacccugggugagaggccagagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161178 - RNA, 1701 nt, Artificial Sequence
  derived and/or modified sequence opt4 from hemagglutinin__InfluenzaA__AFH00296
augaagaccaucaucgcccugagcuacaucuucugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccagagcggcggcagcuacgccugcaagagaggcagcgugaacagcuucuucagcagacugaacuggcugcacgagagcgaguacaaguaccccgcccugaacgugaccaugcccaacaacggcaaguucgacaagcuguacaucuggggcgugcaccaccccagcaccgacagagagcagaccaaccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaccagcugcuuccugcugugcguggugcugcugggcuucaucaugugggccugccagaagggcaacaucagaugcaacaucugcaucuga

SEQ ID NO: 161179 - RNA, 1701 nt, Artificial Sequence
  derived and/or modified sequence opt4 from hemagglutinin__InfluenzaA__AFH00307
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcggcagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcagagugaccgugagcaccaagagaagccagcagaccgugacccccaacaucggcagcagacccugggugagaggccagagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161180 - RNA, 1701 nt, Artificial Sequence; identical to SEQ ID NO: 161179
  derived and/or modified sequence opt4 from hemagglutinin__InfluenzaA__AFH00318

SEQ ID NO: 161181 - RNA, 1701 nt, Artificial Sequence
  derived and/or modified sequence opt4 from hemagglutinin__InfluenzaA__AFH00329
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagccaccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagcaucuacgugagagccagcggcagagugaccgugagcaccaagagaagccagcagaccgugauccccaacaucggcagcagacccugggugagaggcaucagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaccagcugcuuccugcugugcguggugcugcugggcuucaucaugugggccugccagaagggcaacaucagaugcaacaucugcaucuga

SEQ ID NO: 161182 - RNA, 1701 nt, Artificial Sequence
  derived and/or modified sequence opt4 from hemagglutinin__InfluenzaA__AFH00340
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcagagugaccgugagcaccaagagaagccagcagaccgugauccccaacaucggcuucagacccugggugagaggccugagcagcagaaucagcaucuacuggaccaucgugaagcccggcgacauccugcugaucagcagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacauccccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccggccugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161183 - RNA, 1701 nt, Artificial Sequence
  derived and/or modified sequence opt4 from hemagglutinin__InfluenzaA__AFH00351
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaccaaggagggcuucaacuggaccggcguggcccaggacggcaagagcuacgccugcaagagaggcagcgugaagagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcaucagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcaacagcgagugcaucacccccgacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacaagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161184 - RNA, 1701 nt, Artificial Sequence
  derived and/or modified sequence opt4 from hemagglutinin__InfluenzaA__AFH00362
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaccaacgagggcuucaacuggaccggcguggcccaggacggcaagagcuacgccugcaagagaggcagcgugaagagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcaucagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucgacaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaccagcugcuuccugcugugcguggugcugcugggcuucaucaugugggccugccagaagggcaacaucagaugcaacaucugcaucuga

SEQ ID NO: 161185 - RNA, 1701 nt, Artificial Sequence
  derived and/or modified sequence opt4 from hemagglutinin__InfluenzaA__AFH00384
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaccaaggagggcuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcaucagcagcagaaucagcaucuacuggaccaucgugaagcccggcgacauccugcugaucaacagcaucggcaaccugaucgcccccagaggcuacuucaagaucagaaacggcaagagcagcaucaugagaagcgacgcccccaucggcaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccggccugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161186 - RNA, 1701 nt, Artificial Sequence
  derived and/or modified sequence opt4 from hemagglutinin__InfluenzaA__AFH00395
augaaggccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaccaaggagggcuucaacuggaccggcguggcccaggacggcaagagcuacgccugcaagagaggcagcgugaacggcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcaucagcagcagaaucagcaucuacuggaccaucgugaagcccggcgacauccugcugaucaagagcaccggcaaccugaucgcccccagaggcuacuucaagaucagaaacggcaagagcagcaucaugagaagcgacgcccccaucggcaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161187 - RNA, 1701 nt, Artificial Sequence
  derived and/or modified sequence opt4 from hemagglutinin__InfluenzaA__AFH00417
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaccaacgagggcuucaacuggaccggcguggcccaggacggcaagagcuacgccugcaagagaggcagcgugaagagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcaucagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucgacaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161188 - RNA, 1701 nt, Artificial Sequence; identical to SEQ ID NO: 153508
  derived and/or modified sequence opt4 from hemagglutinin__InfluenzaA__AFH00428

SEQ ID NO: 161189 - RNA, 1701 nt, Artificial Sequence
  derived and/or modified sequence opt4 from hemagglutinin__InfluenzaA__AFH00439
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaccaacgagggcuucaacuggaccggcguggcccaggacggcaccagcuacgccugcaagagaggcagcgugaagagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugagcaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161190 - RNA, 1701 nt, Artificial Sequence
  derived and/or modified sequence opt4 from hemagglutinin__InfluenzaA__AFH00450
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacggcccccacagaaucaucgacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaccaacgagagcuucaacuggaccggcguggcccagaacggcaccagcuacgccugcaagagaggcagcgugaagagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcagagcagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucgacaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugaucgacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161191 - RNA, 1701 nt, Artificial Sequence
  derived and/or modified sequence opt4 from hemagglutinin__InfluenzaA__AFH00461
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagccccaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgagaacuucaacuggaccggcguggcccaggacggcaagagcuacgccugcaagagaggcagcgugaacagcuucuucagcagacugaacuggcugcacaagcuggacuacaaguaccccgcccugaacgugaccaugcccaacaacggcaaguucgacaagcuguacaucuggggcgugcaccaccccagcaccgacagcgaccagaucagccuguacgugagaagcagcggcagagugaccgugagcaccaagagaagccagcagaccgugauccccgacaucggcuacagacccugggugagaggccugagcagcagaaucagcaucuacuggaccaucgugaagcccggcgacauccugcugaucaacagcaccggcaaccugaucgcccccagaggcuacuucaagcugagaaacggcaagagcagcaucaugagaagcgacgcccccaucggcaacugcagcagcggcugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugguggagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161192 - RNA, 1701 nt, Artificial Sequence
  derived and/or modified sequence opt4 from hemagglutinin__InfluenzaA__AFH00472
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugagcgacuacgccagccugagaagccugguggccagcagcggcacccuggaguucaacaacgagagcuucaacuggaccggcguggcccagaacggcaccagcuacgccugcaagagaagaagcgugaagagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161193 - RNA, 1701 nt, Artificial Sequence
  derived and/or modified sequence opt4 from hemagglutinin__InfluenzaA__AFH00483
augaagaccaucaucgcccugagcuacauccugugcaugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcaagaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcuacgccugcaagagaggcagcgugaagagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161194 - RNA, 1701 nt, Artificial Sequence
  derived and/or modified sequence opt4 from hemagglutinin__InfluenzaA__AFH00494
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagccccaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgagaacuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcagagugaccgugagcaccaagagaagccagcagaccgugauccccgacaucggcuacagacccugggugagaggccagagcagcagaaucggcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugguggagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161195 - RNA, 1701 nt, Artificial Sequence
  derived and/or modified sequence opt4 from hemagglutinin__InfluenzaA__AFH00505
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaccaacgagggcuucaacuggaccggcguggcccaggacggcaccagcuacgccugcaagagaggcagcgugaagagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaucagccuguacgugcaggccagcggcagagugaccgugagcaccaagagaagccagcagaccgugauccccaacaucggcagcagacccugggugagaggcgugagcagcaucaucagcaucuacuggaccaucgugaagcccggcgacauccugcugaucaacagcaccggcaaccugaucgcccccagaggcuacuucaagaucagaagcggcaagagcagcaucaugagaagcgacgcccccaucgacaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161196 - RNA, 1701 nt, Artificial Sequence
  derived and/or modified sequence opt4 from hemagglutinin__InfluenzaA__AFH00516
augaagaccaucaucgcccugagcuacauccugugccagguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaccaacgagggcuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcaucagcagcagaaucagcaucuacuggaccaucgugaagcccggcgacauccugcugaucaagagcaccggcaaccugaucgcccccagaggcuacuucaagaucagaaacggcaagagcagcaucaugagaagcgacgcccccaucgacaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161197 - RNA, 1701 nt, Artificial Sequence
  derived and/or modified sequence opt4 from hemagglutinin__InfluenzaA__AFH00527
augaagaccaucaucgcccugagcuacauccugugccugguguucgcccagaagauccccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcuacgccugcaagagaagaagcaucaagagcuucuucagcagacugaacuggcugcaccagcugaaguacaaguaccccgcccugaacgugaccaugcccaacaacgacaaguucgacaagcuguacaucuggggcgugcaccaccccagcaccgacagcgaccagaccagccuguacgcccaggccagcggcagagugaccgugagcaccaagagaagccagcagaccgugauccccaacaucggcagcagacccugggugagaggcgugagcagcagaaucagcauccacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161198 - RNA, 1701 nt, Artificial Sequence
  derived and/or modified sequence opt4 from hemagglutinin__InfluenzaA__AFH00538
augaagaccaucaucgcccugagcuacauccugugccugguguucgcccagaagauccccggcaacgacaacagcaccgccacccugugccugggccaccacgccgugcccaacggcacccuggugaagaccaucaccaacgaccagaucgaggugaccaacgccaccgagcuggugcagagaagcagcaccggcagaaucugcgacagcccccacagaauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcuacgccugcaagagaagaagcaucaagagcuucuucagcagacugaacuggcugcaccagcugaaguacaaguaccccgcccugaacgugaccaugcccaacaacgacaaguucgacaagcuguacaucuggggcgugcaccaccccagcaccgacagcgaccagaccagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161199 - RNA, 1701 nt, Artificial Sequence
  derived and/or modified sequence opt4 from hemagglutinin__InfluenzaA__AFH00549
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgacaaguucgacaagcuguacaucuggggcgugcaccaccccagcaccgacagcgaccagaccagccuguacgcccaggcccccggcagagugaccgugagcaccagaagaagccagcagaccgugauccccaacaucggcagcagacccugggugagaggcgugagcagcaucaucagcaucuacuggaccaucgugaagcccggcgacauccugcugaucaacagcaccggcaaccugaucgcccccagaggcuacuucaagaucagaagcggcaagagcagcaucaugagaagcgacgcccccaucagcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161200 - RNA, 1701 nt, Artificial Sequence
  derived and/or modified sequence opt4 from hemagglutinin__InfluenzaA__AFH00560
augaagaccaucaucgcccugagcuacauccugugccugguguucgcccagaagcugcccgugaacgacaacagcaccgccacccugugccugggccaccacgccgugcccaacggcacccuggugaagaccaucaccaacgaccacaucgaggugaccaacgccaccgagcuggugcagagcagcagcaccggcagaaucugcgacaucccccaccagauccuggacggcgagaacugcacccugaucgacgcccugcugggcgacccccacugcgacggcuuccagaacaaggagugggaccuguucguggagagaagcaccgccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggcccccggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgaggccgagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 161201 - RNA, 1701 nt, Artificial Sequence
  derived and/or modified sequence opt4 from hemagglutinin__InfluenzaA__AFH00571
augaagaccaucaucgcccugagcuacauccugugccugguguucgcccagaagcugcccgugaacgacaacagcaccgccacccugugccugggccaccacgccgugcccaacggcacccuggugaagaccaucaccaacgacaacaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaccgccuacagcaacugcuaccccuacgacgugcccgacuacgccagccugagaagccugguggccagcagcggcacccuggaguucaacaacgagagcuucaacuggaccggcguggaccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcaacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161202 - RNA, 1701 nt, Artificial Sequence
  derived and/or modified sequence opt4 from hemagglutinin__InfluenzaA__AFH00582
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggcccccggcagagugaccgugagcaccaagagaagccagcagaccgugauccccaacaucggcagcagacccugggugagaggcgugagcagcagaaucagcaucuacuggaccaucgugaagcccggcgacauccugcugaucaacugcaccggcaaccugaucgcccccagaggcuacuucaagaucagaagcggcaagagcagcaucaugagaagcgacgccagcaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaccagcugcuuccugcugugcguggugcugcugggcuucaucaugugggccugccagaagggcaacaucagaugcaacaucugcaucuga

SEQ ID NO: 161203 - RNA, 1701 nt, Artificial Sequence; identical to SEQ ID NO: 153825
  derived and/or modified sequence opt4 from hemagglutinin__InfluenzaA__AFH00593

SEQ ID NO: 161204 - RNA, 1701 nt, Artificial Sequence; identical to SEQ ID NO: 153825
  derived and/or modified sequence opt4 from hemagglutinin__InfluenzaA__AFH00604

SEQ ID NO: 161205 - RNA, 1701 nt, Artificial Sequence
  derived and/or modified sequence opt4 from hemagglutinin__InfluenzaA__AFH00615
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcaacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacaucagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggacaucgagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucgagagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161206 - RNA, 1701 nt, Artificial Sequence; identical to SEQ ID NO: 160797
  derived and/or modified sequence opt4 from hemagglutinin__InfluenzaA__AFH00626

SEQ ID NO: 161207 - RNA, 1701 nt, Artificial Sequence
  derived and/or modified sequence opt4 from hemagglutinin__InfluenzaA__AFH00637
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcagcugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccaacaacgaccagaucagccuguacacccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161208 - RNA, 1701 nt, Artificial Sequence
  derived and/or modified sequence opt4 from hemagglutinin__InfluenzaA__AFH00648
augaagaccaucaucgcccugagcuacauccugugccugguguucgcccagaagcugcccggcaacgacgacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacgacgagagcuucaacuggaccggcgugacccagaacggcaccagcagcagcugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccgugaccgacaacgaccagaucuuccuguacgcccaggccagcggcagaaucaccgugagcaccaagagaagccagcagaccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161209 - RNA, 1701 nt, Artificial Sequence
  derived and/or modified sequence opt4 from hemagglutinin__InfluenzaA__AFH00659
augaagaccaucaucgcccugagcuacauccugugccugguguucacccagaagcugcccggcaacgacaacagcaccgccacccugugccugggccaccacgccgugcccaacggcaccauggugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugaucgccagcagcggcacccuggaguucaacaacgagagcuucaacuggaccggcgugacccagaacggcaccagcagcgccugcaagagaagaagcgacaacagcuucuucagcagacugaacuggcugacccaccugaaguucaaguaccccgcccugaacgugaccaugcccaacaacgaggaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcggcugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161210 - RNA, 1701 nt, Artificial Sequence
  derived and/or modified sequence opt4 from hemagglutinin__InfluenzaA__AFH00670
augaagaccaucaucgcccugagcuacauccugugccugguguucgcccagaagcugcccggcaucgacaacagcaccgccacccugugccugggccaccacgccgugcccaacggcaccaucgugaagaccaucaccaacgaccagaucgaggugaccaacgccaccgagcuggugcagaacagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaggcagcaacaacagcuucuucagcagacugaacuggcugacccacagcaaguucaaguaccccgcccugaacgugaccaugcccaacaacgaggaguucgacaagcuguacaucuggggcgugcugcaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161211 - RNA, 1701 nt, Artificial Sequence
  derived and/or modified sequence opt4 from hemagglutinin__InfluenzaA__AFH00681
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucaucgagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaaggagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161212 - RNA, 1701 nt, Artificial Sequence; identical to SEQ ID NO: 154448
  derived and/or modified sequence opt4 from hemagglutinin__InfluenzaA__AFH00692

SEQ ID NO: 161213 - RNA, 1701 nt, Artificial Sequence
  derived and/or modified sequence opt4 from hemagglutinin__InfluenzaA__AFH00703
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcaagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguacagcgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaugcagagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161214 - RNA, 1701 nt, Artificial Sequence
  derived and/or modified sequence opt4 from hemagglutinin__InfluenzaA__AFH00714
augaagaccaucaucgcccugagcuacaucuucugccugguguucgcccagaaccugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucaucaacgagggcuucaacuggaccggcgugacccagagcggcggcagcuacgccugcaagagaggcagcgacaagagcuucuucagcagacugaacuggcuguacgagagcgagagcaaguaccccgugcugaacgugaccaugcccaacaacggcaacuucgacaagcuguacaucuggggcgugcaccaccccagcaccgacaaggagcagaccaaccuguacgugagagccagcggcagagugaccgugagcaccaagagaagccagcagaccaucauccccaacaucggcagcagacccugggugagaggccugagcagcggcaucagcaucuacuggaccaucgugaagcccggcgacauccugcugaucaacagcaacggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161215 - RNA, 1701 nt, Artificial Sequence
  derived and/or modified sequence opt4 from hemagglutinin__InfluenzaA__AFH00725
augaagaccaucaucgcccugagcuacaucuucugccugaucuucgcccagaaccugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucaucaacgagggcuucaacuggaccggcgugacccagagcggcggcagcuacgccugcaagagaggcagcgacaacagcuucuucagcagacugaacuggcuguacgagagcgagagcaaguaccccgugcugaacgugaccaugcccaacaacggcaaguucgacaagcuguacaucuggggcgugcaccaccccagcaccgacaaggagcagaccaagcuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacaagaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161216 - RNA, 1701 nt, Artificial Sequence; identical to SEQ ID NO: 159586
  derived and/or modified sequence opt4 from hemagglutinin__InfluenzaA__AFH00736

SEQ ID NO: 161217 - RNA, 1701 nt, Artificial Sequence
  derived and/or modified sequence opt4 from hemagglutinin__InfluenzaA__AFH00747
augaagaccaucaucgcccugagcuacaucuucugccugguguucgcccagaagcugcccggcaacgacaacagcaccgccacccugugccugggccacuacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacgagaagugggaccuguucguggagagaagcaaggccuacagcaacugcuaccccuacgacgugcccgacuacgccagccugagaagccugguggccagcagcggcacccuggaguucaucaacgaggacuucaacuggaccggcgugacccagagcggcggcagcuacgccugcaagagaggcagcgugaagagcuucuucagcagacugaacuggcugcacgagagcgaguacaaguaccccgcccugaacgugaccaugcccaacaacggcaaguucgacaagcuguacaucuggggcgugcaccaccccagcaccgacagagagcagaccaaccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacaagaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161218 - RNA, 1701 nt, Artificial Sequence
  derived and/or modified sequence opt4 from hemagglutinin__InfluenzaA__AFH00758
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccagagcggcgagagcuacgccugcaagagaggcagcgugaagagcuucuucagcagacugaacuggcugcacgagagcgaguacaaguaccccgcccugaacgugaccaugcccaacaacggcaaguucgacaagcuguacaucuggggcgugcaccaccccagcaccgacagagagcagaccaagcuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161219 - RNA, 1701 nt, Artificial Sequence
  derived and/or modified sequence opt4 from hemagglutinin__InfluenzaA__AFH00769
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccagagcggcgagagcuacaccugcaagagaggcagcgugaagagcuucuucagcagacugaacuggcugcacgagagcgaguacaaguaccccgcccugaacgugaccaugcccaacaacgacaaguucgacaagcuguacaucuggggcgugcaccaccccagcaccgacagagagcagaccagccuguacaucagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161220 - RNA, 1701 nt, Artificial Sequence
  derived and/or modified sequence opt4 from hemagglutinin__InfluenzaA__AFH00780
augagagccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcgacugcuaccccuacgacgugcccgacuacgccagccugagaagccugguggccagcagcggcacccuggaguucaccaacgagggcuucaacuggaccggcguggcccaggacggcaccagcuacgccugcaagagaggcagcgugaagagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161221 - RNA, 1701 nt, Artificial Sequence
  derived and/or modified sequence opt4 from hemagglutinin__InfluenzaA__AFH00791
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagggcagcagcaccggcagaaucugcgacagcccccaccagauccuggacggcaagaacugcacccugaucgacgcccugcugggcgacccccacugcgacggcuuccagaacaaggagugggaccuguucguggagagaagcaccgccuacagcaacugcuaccccuacgacgugcccgacuacgccagccugagaagccugguggccagcagcggcacccuggaguucaccaaggagggcuucaacuggaccggcguggcccaggacggcaccagcuacaccugcaagagaggcagcgugaagagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucgacaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161222 - RNA, 1701 nt, Artificial Sequence; identical to SEQ ID NO: 153862
  derived and/or modified sequence opt4 from hemagglutinin__InfluenzaA__AFH00802

SEQ ID NO: 161223 - RNA, 1701 nt, Artificial Sequence
  derived and/or modified sequence opt4 from hemagglutinin__InfluenzaA__AFH00813
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagagacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161224 - RNA, 1701 nt, Artificial Sequence
  derived and/or modified sequence opt4 from hemagglutinin__InfluenzaA__AFH00824
augaagaccaucaucgcccugagcuacauccugagacugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaucggcgagaucugcaacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161225 - RNA, 1701 nt, Artificial Sequence
  derived and/or modified sequence opt4 from hemagglutinin__InfluenzaA__AFH01407
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcaacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacaucagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucgagagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161226 - RNA, 1701 nt, Artificial Sequence
  derived and/or modified sequence opt4 from hemagglutinin__InfluenzaA__AFH34940
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccggcagcgagaugaacaagcuguucgagaagaccaagaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161227 - RNA, 1701 nt, Artificial Sequence
  derived and/or modified sequence opt4 from hemagglutinin__InfluenzaA__AFH34961
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccgccagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161228 - RNA, 1701 nt, Artificial Sequence
  derived and/or modified sequence opt4 from hemagglutinin__InfluenzaA__AFH34968
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccgccagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgccugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161229 - RNA, 1701 nt, Artificial Sequence
  derived and/or modified sequence opt4 from hemagglutinin__InfluenzaA__AFH34975
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagaacagcagcaucggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaacggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagcccagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161230 - RNA, 1701 nt, Artificial Sequence; identical to SEQ ID NO: 155931
  derived and/or modified sequence opt4 from hemagglutinin__InfluenzaA__AFH74464

SEQ ID NO: 161231 - RNA, 1701 nt, Artificial Sequence; identical to SEQ ID NO: 155189
  derived and/or modified sequence opt4 from hemagglutinin__InfluenzaA__AFH74465

SEQ ID NO: 161232 - RNA, 1701 nt, Artificial Sequence; identical to SEQ ID NO: 155950
  derived and/or modified sequence opt4 from hemagglutinin__InfluenzaA__AFH74477

SEQ ID NO: 161233 - RNA, 1701 nt, Artificial Sequence
  derived and/or modified sequence opt4 from hemagglutinin__InfluenzaA__AFH74488
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacaacccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161234 - RNA, 1701 nt, Artificial Sequence; identical to SEQ ID NO: 155931
  derived and/or modified sequence opt4 from hemagglutinin__InfluenzaA__AFH74499

SEQ ID NO: 161235 - RNA, 1701 nt, Artificial Sequence; identical to SEQ ID NO: 156133
  derived and/or modified sequence opt4 from hemagglutinin__InfluenzaA__AFH74510

SEQ ID NO: 161236 - RNA, 1701 nt, Artificial Sequence
  derived and/or modified sequence opt4 from hemagglutinin__InfluenzaA__AFH74521
augaagaccaucaucgcccugagcuacauccugugccugguguucgcccagaagauccccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccacagcaagagcaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugaagagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagguggaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161237 - RNA, 1701 nt, Artificial Sequence; identical to SEQ ID NO: 159508
  derived and/or modified sequence opt4 from hemagglutinin__InfluenzaA__AFH74532

SEQ ID NO: 161238 - RNA, 1701 nt, Artificial Sequence; identical to SEQ ID NO: 156133
  derived and/or modified sequence opt4 from hemagglutinin__InfluenzaA__AFH74543

SEQ ID NO: 161239 - RNA, 1701 nt, Artificial Sequence; identical to SEQ ID NO: 156133
  derived and/or modified sequence opt4 from hemagglutinin__InfluenzaA__AFH74554

SEQ ID NO: 161240 - RNA, 1701 nt, Artificial Sequence; identical to SEQ ID NO: 156133
  derived and/or modified sequence opt4 from hemagglutinin__InfluenzaA__AFH74565

SEQ ID NO: 161241 - RNA, 1701 nt, Artificial Sequence; identical to SEQ ID NO: 156133
  derived and/or modified sequence opt4 from hemagglutinin__InfluenzaA__AFH74576

SEQ ID NO: 161242 - RNA, 1701 nt, Artificial Sequence; identical to SEQ ID NO: 156133
  derived and/or modified sequence opt4 from hemagglutinin__InfluenzaA__AFH74587

SEQ ID NO: 161243 - RNA, 1701 nt, Artificial Sequence
  derived and/or modified sequence opt4 from hemagglutinin__InfluenzaA__AFH74598
augaagaccaucaucgcccugagcuacauccugugccugguguucgcccagaagcugcccgagaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgccauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161244 - RNA, 1701 nt, Artificial Sequence; identical to SEQ ID NO: 155931
  derived and/or modified sequence opt4 from hemagglutinin__InfluenzaA__AFH74609

SEQ ID NO: 161245 - RNA, 1701 nt, Artificial Sequence; identical to SEQ ID NO: 156133
  derived and/or modified sequence opt4 from hemagglutinin__InfluenzaA__AFH74620

SEQ ID NO: 161246 - RNA, 1701 nt, Artificial Sequence
  derived and/or modified sequence opt4 from hemagglutinin__InfluenzaA__AFH74631
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaccaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgccauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161247 - RNA, 1701 nt, Artificial Sequence; identical to SEQ ID NO: 155931
  derived and/or modified sequence opt4 from hemagglutinin__InfluenzaA__AFH74642

SEQ ID NO: 161248 - RNA, 1701 nt, Artificial Sequence; identical to SEQ ID NO: 155931
  derived and/or modified sequence opt4 from hemagglutinin__InfluenzaA__AFH74653

SEQ ID NO: 161249 - RNA, 1701 nt, Artificial Sequence; identical to SEQ ID NO: 155931
  derived and/or modified sequence opt4 from hemagglutinin__InfluenzaA__AFH74664

SEQ ID NO: 161250 - RNA, 1701 nt, Artificial Sequence; identical to SEQ ID NO: 155931
  derived and/or modified sequence opt4 from hemagglutinin__InfluenzaA__AFH74675

SEQ ID NO: 161251 - RNA, 1701 nt, Artificial Sequence; identical to SEQ ID NO: 160679
  derived and/or modified sequence opt4 from hemagglutinin__InfluenzaA__AFH74686

SEQ ID NO: 161252 - RNA, 1701 nt, Artificial Sequence; identical to SEQ ID NO: 160679
  derived and/or modified sequence opt4 from hemagglutinin__InfluenzaA__AFH74697

SEQ ID NO: 161253 - RNA, 1701 nt, Artificial Sequence; identical to SEQ ID NO: 156133
  derived and/or modified sequence opt4 from hemagglutinin__InfluenzaA__AFH74708

SEQ ID NO: 161254 - RNA, 1701 nt, Artificial Sequence; identical to SEQ ID NO: 156133
  derived and/or modified sequence opt4 from hemagglutinin__InfluenzaA__AFH74719

SEQ ID NO: 161255 - RNA, 1701 nt, Artificial Sequence; identical to SEQ ID NO: 156133
  derived and/or modified sequence opt4 from hemagglutinin__InfluenzaA__AFH74730

SEQ ID NO: 161256 - RNA, 1701 nt, Artificial Sequence
  derived and/or modified sequence opt4 from hemagglutinin__InfluenzaA__AFH74741
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgccauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161257 - RNA, 1701 nt, Artificial Sequence; identical to SEQ ID NO: 156133
  derived and/or modified sequence opt4 from hemagglutinin__InfluenzaA__AFH74752

SEQ ID NO: 161258 - RNA, 1701 nt, Artificial Sequence; identical to SEQ ID NO: 156133
  derived and/or modified sequence opt4 from hemagglutinin__InfluenzaA__AFH74763

SEQ ID NO: 161259 - RNA, 1701 nt, Artificial Sequence; identical to SEQ ID NO: 156133
  derived and/or modified sequence opt4 from hemagglutinin__InfluenzaA__AFH74774

SEQ ID NO: 161260 - RNA, 1701 nt, Artificial Sequence; identical to SEQ ID NO: 159508
  derived and/or modified sequence opt4 from hemagglutinin__InfluenzaA__AFH74785

SEQ ID NO: 161261 - RNA, 1701 nt, Artificial Sequence; identical to SEQ ID NO: 156133
  derived and/or modified sequence opt4 from hemagglutinin__InfluenzaA__AFH74796

SEQ ID NO: 161262 - RNA, 1701 nt, Artificial Sequence; identical to SEQ ID NO: 160689
  derived and/or modified sequence opt4 from hemagglutinin__InfluenzaA__AFH74807

SEQ ID NO: 161263 - RNA, 1701 nt, Artificial Sequence; identical to SEQ ID NO: 160689
  derived and/or modified sequence opt4 from hemagglutinin__InfluenzaA__AFH74818

SEQ ID NO: 161264 - RNA, 1701 nt, Artificial Sequence; identical to SEQ ID NO: 160689
  derived and/or modified sequence opt4 from hemagglutinin__InfluenzaA__AFH74829

SEQ ID NO: 161265 - RNA, 1701 nt, Artificial Sequence; identical to SEQ ID NO: 160689
  derived and/or modified sequence opt4 from hemagglutinin__InfluenzaA__AFH74840

SEQ ID NO: 161266 - RNA, 1701 nt, Artificial Sequence
  derived and/or modified sequence opt4 from hemagglutinin__InfluenzaA__AFH74851
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacggcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgccauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugagacuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161267 - RNA, 1701 nt, Artificial Sequence; identical to SEQ ID NO: 160692
  derived and/or modified sequence opt4 from hemagglutinin__InfluenzaA__AFH74862

SEQ ID NO: 161268 - RNA, 1701 nt, Artificial Sequence; identical to SEQ ID NO: 160692
  derived and/or modified sequence opt4 from hemagglutinin__InfluenzaA__AFH74873

SEQ ID NO: 161269 - RNA, 1701 nt, Artificial Sequence; identical to SEQ ID NO: 156133
  derived and/or modified sequence opt4 from hemagglutinin__InfluenzaA__AFH74884

SEQ ID NO: 161270 - RNA, 1701 nt, Artificial Sequence; identical to SEQ ID NO: 156133
  derived and/or modified sequence opt4 from hemagglutinin__InfluenzaA__AFH74895

SEQ ID NO: 161271 - RNA, 1701 nt, Artificial Sequence; identical to SEQ ID NO: 156133
  derived and/or modified sequence opt4 from hemagglutinin__InfluenzaA__AFH74906

SEQ ID NO: 161272 - RNA, 1701 nt, Artificial Sequence; identical to SEQ ID NO: 155931
  derived and/or modified sequence opt4 from hemagglutinin__InfluenzaA__AFH74917

SEQ ID NO: 161273 - RNA, 1701 nt, Artificial Sequence; identical to SEQ ID NO: 156133
  derived and/or modified sequence opt4 from hemagglutinin__InfluenzaA__AFH74928

SEQ ID NO: 161274 - RNA, 1701 nt, Artificial Sequence; identical to SEQ ID NO: 156133
  derived and/or modified sequence opt4 from hemagglutinin__InfluenzaA__AFH74939

SEQ ID NO: 161275 - RNA, 1701 nt, Artificial Sequence
  derived and/or modified sequence opt4 from hemagglutinin__InfluenzaA__AFH74950
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacggcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgccauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161276 - RNA, 1701 nt, Artificial Sequence; identical to SEQ ID NO: 160692
  derived and/or modified sequence opt4 from hemagglutinin__InfluenzaA__AFH74961

SEQ ID NO: 161277 - RNA, 1701 nt, Artificial Sequence; identical to SEQ ID NO: 156133
  derived and/or modified sequence opt4 from hemagglutinin__InfluenzaA__AFH75388

SEQ ID NO: 161278 - RNA, 1701 nt, Artificial Sequence
  derived and/or modified sequence opt4 from hemagglutinin__InfluenzaA__AFH97140
augaaggccauccugguggugcugcuguacaucuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161279 - RNA, 1701 nt, Artificial Sequence
  derived and/or modified sequence opt4 from hemagglutinin__InfluenzaA__AFJ05142
augaagaccaucaucgcccugagcuacauccugugccugguguucgcccagaagauccccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagugcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcggcugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161280 - RNA, 1701 nt, Artificial Sequence
  derived and/or modified sequence opt4 from hemagglutinin__InfluenzaA__AFJ05144
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacagcagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccagagcagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161281 - RNA, 1701 nt, Artificial Sequence
  derived and/or modified sequence opt4 from hemagglutinin__InfluenzaA__AFJ11706
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagcagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaccaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161282 - RNA, 1701 nt, Artificial Sequence; identical to SEQ ID NO: 159502
  derived and/or modified sequence opt4 from hemagglutinin__InfluenzaA__AFJ11728

SEQ ID NO: 161283 - RNA, 1701 nt, Artificial Sequence
  derived and/or modified sequence opt4 from hemagglutinin__InfluenzaA__AFJ19842
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcgccggcgagaucugcgacagcccccaccacauccuggacggcgagaacugcacccugaucgacgcccugcugggcgacccccagugcgacggcuuccagaacaagaagugggaccuguucguggagagaagcagagccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcaucgagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161284 - RNA, 1701 nt, Artificial Sequence; identical to SEQ ID NO: 160881
  derived and/or modified sequence opt4 from hemagglutinin__InfluenzaA__AFJ20171

SEQ ID NO: 161285 - RNA, 1701 nt, Artificial Sequence; identical to SEQ ID NO: 159502
  derived and/or modified sequence opt4 from hemagglutinin__InfluenzaA__AFJ20182

SEQ ID NO: 161286 - RNA, 1701 nt, Artificial Sequence
  derived and/or modified sequence opt4 from hemagglutinin__InfluenzaA__AFJ74386
augaaggccaagcugcuggugcugcugugcgccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaccgccccccugcagcugggcaacugcagcguggccggcuggauccugggcaaccccgagugcgagagccuguucagcaaggagagcuggagcuacaucgccgagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccaagggcgugaccgccagcugcagccacaacggcaagagcagcuucuacaagaaccugcuguggcugaccgagaagaacggccuguaccccaaccugagcaagagcuacgugaacaacaaggagaaggaggugcuggugcuguggggcgugcaccaccccagcaacaucggcgaccagagagccaucuaccacaccgagaacgccuacgugagcgugaugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgccagcaugggcgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucgacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagaaccagcugaagaacaacgccaaggagaucggcaacggcugcuucgaguucuaccacaagugcaacaacgagugcauggagagcgugaagaacggcaccuacgacuaccccaaguacagcggcgagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 161287 - RNA, 1701 nt, Artificial Sequence
  derived and/or modified sequence opt4 from hemagglutinin__InfluenzaA__AFJ74407
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaccaacgagggcuucaacuggaccggcguggcccaggacggcaccagcuacgccugcaagagaggcagcgugaagagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161288 - RNA, 1701 nt, Artificial Sequence
  derived and/or modified sequence opt4 from hemagglutinin__InfluenzaA__AFJ74418
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161289 - RNA, 1701 nt, Artificial Sequence
  derived and/or modified sequence opt4 from hemagglutinin__InfluenzaA__AFJ74437
augaagaccaucaucgcccugagcuacauccugugcaagguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161290 - RNA, 1701 nt, Artificial Sequence
  derived and/or modified sequence opt4 from hemagglutinin__InfluenzaA__AFJ74448
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcggcccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161291 - RNA, 1701 nt, Artificial Sequence
  derived and/or modified sequence opt4 from hemagglutinin__InfluenzaA__AFJ74459
auggaggccaagcugcuggugcugcugugcgccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaccgccccccugcagcugggcaacugcagcaucgccggcuggauccugggcaaccccgagugcgagagccuguucagcaaggagagcuggagcuacaucgccgagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccaagggcgugaccgccagcugcagccacaacggcaagagcagcuucuacaagaaccugcuguggcugaccgagaagaacggccuguaccccaaccugagcaagagcuacgugaacaacaaggagaaggaggugcuggugcuguggggcgugcaccaccccagcaacaucggcgaccagagagccaucuaccacaccgagaacgccuacgugagcguggugagcagccacuacagcagaagauucacccccgagaucgccaagagacccaaggugagaaaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgccagcaugggcgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcaucaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagaaccagcugaagaacaacgccaaggagaucggcaacggcugcuucgaguucuaccacaagugcaacaacgagugcauggagagcgugaagaacggcaccuacgacuaccccaaguacagcaaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 161292 - RNA, 1701 nt, Artificial Sequence
  derived and/or modified sequence opt4 from hemagglutinin__InfluenzaA__AFJ74470
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcuacgccugcaagagaagaagcgugaagagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaucagccuguacgcccagaccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161293 - RNA, 1701 nt, Artificial Sequence
  derived and/or modified sequence opt4 from hemagglutinin__InfluenzaA__AFJ74492
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacaagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcaucaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauucaagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161294 - RNA, 1701 nt, Artificial Sequence
  derived and/or modified sequence opt4 from hemagglutinin__InfluenzaA__AFJ74525
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccaggacggcaccagcagcgccugcaagagaagaagcaucaagagcuucuucagcagacugaacuggcugcaccagcugaaguacaaguaccccgcccugaacgugaccaugcccaacaacgacaaguucgacaagcuguacaucuggggcgugcaccaccccagcaccgacagcgaccagaccagccuguacgcccaggccagcggcagagugaccgugagcaccaagagaagccagcagaccgugauccccaacaucggcagcagacccugggugagaggcgugagcagcaucaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcaccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161295 - RNA, 1701 nt, Artificial Sequence; identical to SEQ ID NO: 161293
  derived and/or modified sequence opt4 from hemagglutinin__InfluenzaA__AFJ74535

SEQ ID NO: 161296 - RNA, 1701 nt, Artificial Sequence
  derived and/or modified sequence opt4 from hemagglutinin__InfluenzaA__AFJ74560
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccagaccagcggcagagugaccgugagcaccaagagaagccagcagaccgugauccccaacaucggcagcggccccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggccccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugguggagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 161297 - RNA, 1701 nt, Artificial Sequence
  derived and/or modified sequence opt4 from hemagglutinin__InfluenzaA__AFJ74634
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaagagcuucuucagcagacugaacuggcugacccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161298 - RNA, 1698 nt, Artificial Sequence
  derived and/or modified sequence opt4 from hemagglutinin__InfluenzaA__AFJ74653
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacaagaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgacaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 161299 - RNA, 1698 nt, Artificial Sequence
  derived and/or modified sequence opt4 from hemagglutinin__InfluenzaA__AFJ74673
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacaagaaccugcuguggcugaccggcaagaacggccuguaccccaaccugagaaagagcuacgccaacaacaaggagaaggaggugcuggugcuguggggcgugcaccacccccccaacaucggcgaccagagagcccuguaccacaccgacaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 161300 - RNA, 1701 nt, Artificial Sequence
  derived and/or modified sequence opt4 from hemagglutinin__InfluenzaA__AFJ74674
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccacugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcagaagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagcccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161301 - RNA, 1698 nt, Artificial Sequence; identical to SEQ ID NO: 161298
  derived and/or modified sequence opt4 from hemagglutinin__InfluenzaA__AFJ74694

SEQ ID NO: 161302 - RNA, 1701 nt, Artificial Sequence
  derived and/or modified sequence opt4 from hemagglutinin__InfluenzaA__AFJ74695
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagaacagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccaggacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgccagagccagcggcagagugaccgugagcaccaagagaagccagcagaccgugauccccaacaucggcagcagacccugggugagaggcgugagcagcaagaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggccccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 161303 - RNA, 1701 nt, Artificial Sequence
  derived and/or modified sequence opt4 from hemagglutinin__InfluenzaA__AFJ74727
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaagagcuucuucagcagacugaacuggcugacccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacaucagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaagcggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161304 - RNA, 1698 nt, Artificial Sequence; identical to SEQ ID NO: 161298
  derived and/or modified sequence opt4 from hemagglutinin__InfluenzaA__AFJ74743

SEQ ID NO: 161305 - RNA, 1701 nt, Artificial Sequence; identical to SEQ ID NO: 161297
  derived and/or modified sequence opt4 from hemagglutinin__InfluenzaA__AFJ74744

SEQ ID NO: 161306 - RNA, 1698 nt, Artificial Sequence; identical to SEQ ID NO: 161298
  derived and/or modified sequence opt4 from hemagglutinin__InfluenzaA__AFJ74760

SEQ ID NO: 161307 - RNA, 1701 nt, Artificial Sequence
  derived and/or modified sequence opt4 from hemagglutinin__InfluenzaA__AFJ74761
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaagagcuucuucagcagacugaacuggcugacccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacaucagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161308 - RNA, 1698 nt, Artificial Sequence; identical to SEQ ID NO: 161298
  derived and/or modified sequence opt4 from hemagglutinin__InfluenzaA__AFJ74779

SEQ ID NO: 161309 - RNA, 1701 nt, Artificial Sequence; identical to SEQ ID NO: 161297
  derived and/or modified sequence opt4 from hemagglutinin__InfluenzaA__AFJ74780

SEQ ID NO: 161310 - RNA, 1701 nt, Artificial Sequence
  derived and/or modified sequence opt4 from hemagglutinin__InfluenzaA__AFJ74804
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacagaaagugggaccuguucguggagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161311 - RNA, 1701 nt, Artificial Sequence
  derived and/or modified sequence opt4 from hemagglutinin__InfluenzaA__AFJ74819
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucaaccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161312 - RNA, 1701 nt, Artificial Sequence; identical to SEQ ID NO: 155165
  derived and/or modified sequence opt4 from hemagglutinin__InfluenzaA__AFJ74842

SEQ ID NO: 161313 - RNA, 1698 nt, Artificial Sequence
  derived and/or modified sequence opt4 from hemagglutinin__InfluenzaA__AFJ75036
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcagagagagcuggagcuacaucguggagaagcccaaccccgagaacggcaccugcuaccccggccacuucgccgacuacgaggagcugagagagcagcugagcagcgugagcagcuucgagagauucgagaucuuccccaaggagaacagcuggcccaaccacaccgugaccggcgugagcgccagcugcagccacaacggcaagagcagcuucuacaagaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 161314 - RNA, 1701 nt, Artificial Sequence; identical to SEQ ID NO: 153150
  derived and/or modified sequence opt4 from hemagglutinin__InfluenzaA__AFJ75047

SEQ ID NO: 161315 - RNA, 1698 nt, Artificial Sequence
  derived and/or modified sequence opt4 from hemagglutinin__InfluenzaA__AFJ75058
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcagagagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacaagaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 161316 - RNA, 1698 nt, Artificial Sequence
  derived and/or modified sequence opt4 from hemagglutinin__InfluenzaA__AFJ75069
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcagagagagcuggagcuacaucguggagaagagcaaccccgagaacggcaccugcuaccccggccacuucgccgacuacgaggagcugagagagcagcugagcagcgugagcagcuucgagagauucgagaucuuccccaaggagagcagcuggcccaaccacaccaccaccggcgugagcgccagcugcagccacaacggcgagagcagcuucuacaagaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 161317 - RNA, 1701 nt, Artificial Sequence
  derived and/or modified sequence opt4 from hemagglutinin__InfluenzaA__AFJ75091
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagaucagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgaccugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161318 - RNA, 1701 nt, Artificial Sequence
  derived and/or modified sequence opt4 from hemagglutinin__InfluenzaA__AFJ75449
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcaagaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161319 - RNA, 1701 nt, Artificial Sequence
  derived and/or modified sequence opt4 from hemagglutinin__InfluenzaA__AFJ75460
augaagaccaucaucgcccugagcuacauccugugccugguguucacccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagaacuucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccguggaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161320 - RNA, 1698 nt, Artificial Sequence
  derived and/or modified sequence opt4 from hemagglutinin__InfluenzaA__AFJ75517
augaaggugaagcugcuggugcugcugugcaccuucaccgccaccuacgccgacaccaucugcaucggcuaccacgccaacaacagcaccgacaccguggacaccgugcuggagaagaacgugaccgugaccuacagcgugaaccugcuggaggacaaccacaacggcaagcugugccugcugaagggcaucgccccccugcagcugggcaacugcagcguggccggcuggauccugggcaaccccgagugcgagcugcugaucagcaaggagagcuggagcuacaucguggagagacccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacaagaaccugcuguggcugaccggcaagaacggccuguaccccaaccugagcaagagcuacgccaacaacaaggagaaggaggugcuggugcuguggggcgugcaccacccccccaacaucggcgaccagaugacccuguaccacaagaagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugaacagaggcuucggcagcggcaucaucaacagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacguguggaccuacaacgccgagcugcuggugcugcuggagaacgagagaacccuggacuuccacgacagcaacgugaagaaccuguacgagaaggugaagacccagcugaagaacaacgccaaggagaucggcaacggcugcuucgaguucuaccacaagugcaacgacgagugcauggagagcgugaagaacggcaccuacgacuaccccaaguacagcgaggagagcaagcugagcagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 161321 - RNA, 1698 nt, Artificial Sequence
  derived and/or modified sequence opt4 from hemagglutinin__InfluenzaA__AFJ75560
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacaaccacaacggcaagcugugccugcugaagggcaucgccccccugcagcugggcaacugcagcguggccggcuggauccugggcaaccccgagugcgagcugcugaucagcaaggagagcuggagcuacaucguggagagacccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacaagaaccugcuguggcugaccggcaagaacggccuguaccccaaccugagcaagagcuacgccaacaacaaggagaaggaggugcuggugcuguggggcgugcaccacccccccaacaucggcgaccagaugacccuguaccacaaggagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacgagugcgacgccaagugccagaccccccagggcgccaucaacagcagccugcccuuccagaacgugcaccccgugaccaucggcgagugccccaaguucgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacguguggaccuacaacgccgagcugcuggugcugcuggagaacgagagaacccuggacuuccacgacagcaacgugaagaaccuguacgagaaggugaagaaccagcugagaaacaacgccaaggagaucggcaacggcugcuucgaguucuaccacaagugcaacgacgagugcauggagagcgugaagaacggcaccuacgacuaccccaaguacagcgaggagagcaagcugagcagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 161322 - RNA, 1698 nt, Artificial Sequence
  derived and/or modified sequence opt4 from hemagglutinin__InfluenzaA__AFJ75571
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacaaccacaacggcaagcugugccugcugaagggcaucgccccccugcagcugggcaacugcagcguggccggcuggauccugggcaaccccgagugcgagcugcugaucagcaaggagagcuggagcuacaucguggagagacccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagaacagcuucuacaagaaccugcuguggcugaccggcaagaacggccuguaccccaaccugagcaagagcuacgccaacaacaaggagaaggaggugcuggugcuguggggcgugcaccacccccccaacaucggcgaccagaugacccuguaccacaaggagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacguguggaccuacaacgccgagcugcuggugcugcuggagaacgagagaacccuggacuuccacgacagcaacgugaagaaccuguacgagaaggugaagaaccagcugaagaacaacgccaaggagaucggcaacggcugcuucgaguucuaccacaagugcaacgacgagugcauggagagcgugaagaacggcaccuacgacuaccccaaguacagcgaggagagcaagcugagcagagagagaaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 161323 - RNA, 1701 nt, Artificial Sequence
  derived and/or modified sequence opt4 from hemagglutinin__InfluenzaA__AFJ75593
augaagaccaucaucgcccugagcuacauccugugccugguguucgcccagaagcugcccggcaacgacagcagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagguggaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161324 - RNA, 1698 nt, Artificial Sequence
  derived and/or modified sequence opt4 from hemagglutinin__InfluenzaA__AFJ75615
augaaggugaagcugcuggugcugcugugcaccuucaccgccaccuacgccgacaccaucugcgugggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgaggugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 161325 - RNA, 1701 nt, Artificial Sequence; identical to SEQ ID NO: 157872
  derived and/or modified sequence opt4 from hemagglutinin__InfluenzaA__AFJ75630

SEQ ID NO: 161326 - RNA, 1701 nt, Artificial Sequence; identical to SEQ ID NO: 157872
  derived and/or modified sequence opt4 from hemagglutinin__InfluenzaA__AFJ75641

SEQ ID NO: 161327 - RNA, 1698 nt, Artificial Sequence
  derived and/or modified sequence opt4 from hemagglutinin__InfluenzaA__AFJ75651
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagaaggcccuguacagaaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcgacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 161328 - RNA, 1701 nt, Artificial Sequence
  derived and/or modified sequence opt4 from hemagglutinin__InfluenzaA__AFJ75662
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgaggaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161329 - RNA, 1698 nt, Artificial Sequence
  derived and/or modified sequence opt4 from hemagglutinin__InfluenzaA__AFJ75673
augaaggugaagcugcuggugcugcugugcaccuucaccgccaccuacgccgacaccaucugcaucggcuaccacgccaacaacagcaccgacaccguggacaccgugcuggagaagaacgugaccgugaccuacagcgugaaccugcuggaggacaaccacaacggcaagcugugccugcugaagggcaucgccccccugcagcugggcaacugcagcguggccggcuggauccugggcaaccccgagugcgagcugcugaucagcaaggagagcuggagcuacaucguggagagacccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacaagaaccugcuguggcugaccggcaagaacggccuguaccccaaccugagcaagagcuacgccaacaacaaggagaaggaggugcuggugcuguggggcgugcaccacccccccaacaucggcaaccagaugacccuguaccacaaggagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugaacagaggcuucggcagcggcaucaucaacagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacguguggaccuacaacgccgagcugcuggugcugcuggagaacgagagaacccuggacuuccacgacagcaacgugaagaaccuguacgagaaggugaagacccagcugaagaacaacgccaaggagaucggcaacggcugcuucgaguucuaccacaagugcaacgacgagugcauggagagcgugaagaacggcaccuacgacuaccccaaguacagcgaggagagcaagcugagcagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 161330 - RNA, 1701 nt, Artificial Sequence; identical to SEQ ID NO: 155189
  derived and/or modified sequence opt4 from hemagglutinin__InfluenzaA__AFJ76119

SEQ ID NO: 161331 - RNA, 1701 nt, Artificial Sequence; identical to SEQ ID NO: 155542
  derived and/or modified sequence opt4 from hemagglutinin__InfluenzaA__AFJ76131

SEQ ID NO: 161332 - RNA, 1701 nt, Artificial Sequence
  derived and/or modified sequence opt4 from hemagglutinin__InfluenzaA__AFJ76155
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcaucgccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucgccauggagagaaaggccggcagcggcaucaucaucagcgacacccccgugcacgacugcaacaccaccugccagacccccaagggcgccaucaacaccagccugcccuuccagaacauccacagcaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 161333 - RNA, 1698 nt, Artificial Sequence
  derived and/or modified sequence opt4 from hemagglutinin__InfluenzaA__AFJ76186
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaaaguucacccccgagaucaccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcgacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 161334 - RNA, 1701 nt, Artificial Sequence; identical to SEQ ID NO: 155189
  derived and/or modified sequence opt4 from hemagglutinin__InfluenzaA__AFJ76203

SEQ ID NO: 161335 - RNA, 1701 nt, Artificial Sequence
  derived and/or modified sequence opt4 from hemagglutinin__InfluenzaA__AFJ76213
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccacagcaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161336 - RNA, 1701 nt, Artificial Sequence
  derived and/or modified sequence opt4 from hemagglutinin__InfluenzaA__AFJ77408
augaagaccaucaucgcccugagcuacauccugugccugaucuucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcaacagcccccacagaauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaccaaggagggcuucaacuggaccggcguggcccaggacggcaagagcuacagcugcaagagaggcagcgugaacagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcaucagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161337 - RNA, 1701 nt, Artificial Sequence
  derived and/or modified sequence opt4 from hemagglutinin__InfluenzaA__AFJ77430
augaagaccaucaucgcccugagcuacauccugugccugaucuucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcgagaacugcacccugaucgacgcccugcugggcgaccccaacugcgacggcuuccagaacaaggagugggaccuguucguggagagaagcaaggccuacagcaacugcuaccccuacgacgugcccgacuacgccagccugagaagccugguggccagcagcggcacccuggaguucaccaaggagggcuucaacuggaccggcguggcccaggacggcaagagcuacagcugcaagagaggcagcgugaacagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcaucagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161338 - RNA, 1701 nt, Artificial Sequence
  derived and/or modified sequence opt4 from hemagglutinin__InfluenzaA__AFJ77440
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaccagcgagggcuucaacuggaccggcguggcccaggacggcaccagcuacgccugcaagagaggcagcgugaagagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161339 - RNA, 1701 nt, Artificial Sequence
  derived and/or modified sequence opt4 from hemagglutinin__InfluenzaA__AFJ77451
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcuacgccugcaagagaagaagcgugaagagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacggcaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161340 - RNA, 1701 nt, Artificial Sequence
  derived and/or modified sequence opt4 from hemagglutinin__InfluenzaA__AFJ77462
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaccaacgagggcuucaacuggaccggcguggcccaggacggcaccagcuacgccugcaagagaggcagcgugaagagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161341 - RNA, 1701 nt, Artificial Sequence
  derived and/or modified sequence opt4 from hemagglutinin__InfluenzaA__AFJ77473
augaagaccaucaucgcccugagcuacauccugugccagguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161342 - RNA, 1701 nt, Artificial Sequence; identical to SEQ ID NO: 152706
  derived and/or modified sequence opt4 from hemagglutinin__InfluenzaA__AFJ77484

SEQ ID NO: 161343 - RNA, 1701 nt, Artificial Sequence; identical to SEQ ID NO: 152708
  derived and/or modified sequence opt4 from hemagglutinin__InfluenzaA__AFJ77495

SEQ ID NO: 161344 - RNA, 1701 nt, Artificial Sequence; identical to SEQ ID NO: 152706
  derived and/or modified sequence opt4 from hemagglutinin__InfluenzaA__AFJ77506

SEQ ID NO: 161345 - RNA, 1701 nt, Artificial Sequence
  derived and/or modified sequence opt4 from hemagglutinin__InfluenzaA__AFJ77517
augaagaccaucaucgcccugagcuacauccugugccugguguucgcccagaagauccccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcaacgccugcaagagaagaagcaugaagagcuucuucagcagacugaacuggcugcaccagcugaaguacaaguaccccgcccugaacgugaccaugcccaacaacgacaaguucgacaagcuguacaucuggggcgugcaccaccccagcaccgacagcgaccagaccagccuguacgcccaggccagcggcagagugaccgugagcacccagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaucagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaugagcugcuuccugcugugcguggugcugcugggcuucaucaugugggccugccagaagggcaacaucagaugcaacaucugcaucuga

SEQ ID NO: 161346 - RNA, 1701 nt, Artificial Sequence; identical to SEQ ID NO: 152543
  derived and/or modified sequence opt4 from hemagglutinin__InfluenzaA__AFJ77528

SEQ ID NO: 161347 - RNA, 1698 nt, Artificial Sequence
  derived and/or modified sequence opt4 from hemagglutinin__InfluenzaA__AFJ77550
augaagaccaucaucgcccugagcuacauccugugccagguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcagcaucugcaucuga

SEQ ID NO: 161348 - RNA, 1701 nt, Artificial Sequence
  derived and/or modified sequence opt4 from hemagglutinin__InfluenzaA__AFJ77561
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcuacgccugcaagagaagaagcgugaagagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucuacagcaccggcaaccugaucgcccccagaggcuacuucaagaucagaagcggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161349 - RNA, 1698 nt, Artificial Sequence
  derived and/or modified sequence opt4 from hemagglutinin__InfluenzaA__AFJ77572
augaagaccaucaucgcccugagcuacauccugugccagguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcggccccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcagcaucugcaucuga

SEQ ID NO: 161350 - RNA, 1701 nt, Artificial Sequence
  derived and/or modified sequence opt4 from hemagglutinin__InfluenzaA__AFJ77583
augaagaccaucaucacccugagcuacauccugugccugguguucgcccagaagcugcccgugaaggacaacagcaccgccacccugugccugggccaccacgccgugcccaacggcacccuggugaagaccaucaccaacgaccacaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaccgccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcaacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161351 - RNA, 1701 nt, Artificial Sequence
  derived and/or modified sequence opt4 from hemagglutinin__InfluenzaA__AFJ77594
augaagaccaucaucgcccugagcuacauccugugccugguguucgcccagaagcugcccgugaaggacaacagcaccgccacccugugccugggccaccacgccgugcccaacggcacccuggugaagaccaucaccaacgaccacaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaccgccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcaacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161352 - RNA, 1701 nt, Artificial Sequence
  derived and/or modified sequence opt4 from hemagglutinin__InfluenzaA__AFJ77605
augaagaccaucaucgcccugagcuacauccugugccugaucuucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcaagaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggccgugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161353 - RNA, 1701 nt, Artificial Sequence
  derived and/or modified sequence opt4 from hemagglutinin__InfluenzaA__AFJ77616
augaagaccaucaucgcccugagcuacauccugugcauggugcuggcccagaagcugcccgugaaggacaacagcaccgccacccugugccugggccaccacgccgugcccaacggcacccuggugaagaccaucaccaacgaccacaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaccgccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcaacgccagcaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161354 - RNA, 1701 nt, Artificial Sequence
  derived and/or modified sequence opt4 from hemagglutinin__InfluenzaA__AFJ77627
augaagaccaucaucgcccugagcuacauccugugccuggugcuggcccagaagcugcccgugaaggacaacagcaccgccacccugugccugggccaccacgccgugcccaacggcacccuggugaagaccaucaccaacgaccacaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaccgccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcaacgccagcaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161355 - RNA, 1701 nt, Artificial Sequence
  derived and/or modified sequence opt4 from hemagglutinin__InfluenzaA__AFJ77638
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaccacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161356 - RNA, 1701 nt, Artificial Sequence
  derived and/or modified sequence opt4 from hemagglutinin__InfluenzaA__AFJ77649
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacaacaccggcaaccugaucgcccccagaggcuacuucaagaucagaaacggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauucaagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161357 - RNA, 1701 nt, Artificial Sequence; identical to SEQ ID NO: 152723
  derived and/or modified sequence opt4 from hemagglutinin__InfluenzaA__AFJ77660

SEQ ID NO: 161358 - RNA, 1701 nt, Artificial Sequence; identical to SEQ ID NO: 152723
  derived and/or modified sequence opt4 from hemagglutinin__InfluenzaA__AFJ77671

SEQ ID NO: 161359 - RNA, 1701 nt, Artificial Sequence; identical to SEQ ID NO: 152723
  derived and/or modified sequence opt4 from hemagglutinin__InfluenzaA__AFJ77682

SEQ ID NO: 161360 - RNA, 1701 nt, Artificial Sequence
  derived and/or modified sequence opt4 from hemagglutinin__InfluenzaA__AFJ77693
augaagaccaucaucgcccugagcuacauccugugccugguguucgcccagaagcugcccgugaacgacaacagcaccgccacccugugccugggccaccacaccgugcccaacggcacccuggugaagaccaucaccaacgacaacaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaccgccuacagcaacugcuaccccuacgacgugcccgacuacgccagccugagaagccugguggccagcagcggcacccuggaguucaacaacgagagcuucaacuggaccggcguggaccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcaacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacuucgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 161361 - RNA, 1701 nt, Artificial Sequence; identical to SEQ ID NO: 152723
  derived and/or modified sequence opt4 from hemagglutinin__InfluenzaA__AFJ77704

SEQ ID NO: 161362 - RNA, 1701 nt, Artificial Sequence; identical to SEQ ID NO: 161201
  derived and/or modified sequence opt4 from hemagglutinin__InfluenzaA__AFJ77715

SEQ ID NO: 161363 - RNA, 1701 nt, Artificial Sequence; identical to SEQ ID NO: 161201
  derived and/or modified sequence opt4 from hemagglutinin__InfluenzaA__AFJ77726

SEQ ID NO: 161364 - RNA, 1701 nt, Artificial Sequence; identical to SEQ ID NO: 161297
  derived and/or modified sequence opt4 from hemagglutinin__InfluenzaA__AFJ77737

SEQ ID NO: 161365 - RNA, 1701 nt, Artificial Sequence; identical to SEQ ID NO: 152552
  derived and/or modified sequence opt4 from hemagglutinin__InfluenzaA__AFJ77748

SEQ ID NO: 161366 - RNA, 1701 nt, Artificial Sequence; identical to SEQ ID NO: 152552
  derived and/or modified sequence opt4 from hemagglutinin__InfluenzaA__AFJ77759

SEQ ID NO: 161367 - RNA, 1701 nt, Artificial Sequence
  derived and/or modified sequence opt4 from hemagglutinin__InfluenzaA__AFJ77781
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacagcgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 161368 - RNA, 1701 nt, Artificial Sequence; identical to SEQ ID NO: 154315
  derived and/or modified sequence opt4 from hemagglutinin__InfluenzaA__AFJ77792

SEQ ID NO: 161369 - RNA, 1701 nt, Artificial Sequence; identical to SEQ ID NO: 154315
  derived and/or modified sequence opt4 from hemagglutinin__InfluenzaA__AFJ77803

SEQ ID NO: 161370 - RNA, 1701 nt, Artificial Sequence; identical to SEQ ID NO: 154315
  derived and/or modified sequence opt4 from hemagglutinin__InfluenzaA__AFJ77814

SEQ ID NO: 161371 - RNA, 1701 nt, Artificial Sequence; identical to SEQ ID NO: 154315
  derived and/or modified sequence opt4 from hemagglutinin__InfluenzaA__AFJ77825

SEQ ID NO: 161372 - RNA, 1701 nt, Artificial Sequence; identical to SEQ ID NO: 154315
  derived and/or modified sequence opt4 from hemagglutinin__InfluenzaA__AFJ77836

SEQ ID NO: 161373 - RNA, 1701 nt, Artificial Sequence; identical to SEQ ID NO: 154315
  derived and/or modified sequence opt4 from hemagglutinin__InfluenzaA__AFJ77847
